(12) United States Patent
Mathis et al.

(10) Patent No.: US 10,550,402 B2
(45) Date of Patent: Feb. 4, 2020

(54) MODIFYING SOYBEAN OIL COMPOSITION THROUGH TARGETED KNOCKOUT OF THE FAD3A/B/C GENES

(71) Applicant: CELLECTIS, Paris (FR)

(72) Inventors: Luc Mathis, Le Kremlin Bicetre (FR); Zachary Demorest, Minneapolis, MN (US); Feng Zhang, Maple Grove, MN (US); William Haun, St. Paul, MN (US)

(73) Assignee: CELLECTIS, Paris (FR)

( * ) Notice: Subject to any disclaimer, the term of this patent is extended or adjusted under 35 U.S.C. 154(b) by 0 days.

(21) Appl. No.: 16/053,194

(22) Filed: Aug. 2, 2018

(65) Prior Publication Data

US 2019/0024103 A1    Jan. 24, 2019

Related U.S. Application Data

(63) Continuation of application No. PCT/IB2017/050574, filed on Feb. 2, 2017.

(60) Provisional application No. 62/398,246, filed on Sep. 22, 2016, provisional application No. 62/290,154, filed on Feb. 2, 2016.

(51) Int. Cl.
  *C12N 15/82* (2006.01)
  *A01H 5/10* (2018.01)
  *A01H 6/54* (2018.01)

(52) U.S. Cl.
  CPC .......... *C12N 15/8247* (2013.01); *A01H 5/10* (2013.01); *A01H 6/542* (2018.05); *C12N 15/8205* (2013.01)

(58) Field of Classification Search
  None
  See application file for complete search history.

(56) References Cited

U.S. PATENT DOCUMENTS

| | | |
|---|---|---|
| 4,179,337 A | 12/1979 | Davis et al. |
| 4,683,195 A | 7/1987 | Mullis et al. |
| 4,761,373 A | 8/1988 | Anderson et al. |
| 4,769,061 A | 9/1988 | Comai |
| 4,810,648 A | 3/1989 | Stalker |
| 4,940,835 A | 7/1990 | Shah et al. |
| 4,959,317 A | 9/1990 | Sauer |
| 4,975,374 A | 12/1990 | Goodman et al. |
| 5,006,333 A | 4/1991 | Saifer et al. |
| 5,013,659 A | 5/1991 | Bedbrook et al. |
| 5,162,602 A | 11/1992 | Somers et al. |
| 5,204,253 A | 4/1993 | Sanford et al. |
| 5,276,268 A | 1/1994 | Strauch et al. |
| 5,356,802 A | 10/1994 | Chandrasegaran |
| 5,436,150 A | 7/1995 | Chandrasegaran |
| 5,487,994 A | 1/1996 | Chandrasegaran |
| 5,501,967 A | 3/1996 | Offringa et al. |
| 5,538,880 A | 7/1996 | Lundquist et al. |
| 5,554,798 A | 9/1996 | Lundquist et al. |
| 5,561,236 A | 10/1996 | Leemans et al. |
| 5,591,616 A | 1/1997 | Hiei et al. |
| 5,767,366 A | 6/1998 | Sathasivan et al. |
| 5,792,640 A | 8/1998 | Chandrasegaran |
| 5,879,903 A | 3/1999 | Strauch et al. |
| 5,928,937 A | 7/1999 | Kakefuda et al. |
| 6,084,155 A | 7/2000 | Volrath et al. |
| 6,326,166 B1 | 12/2001 | Pomerantz et al. |
| 6,329,571 B1 | 12/2001 | Hiei |
| 6,368,227 B1 | 4/2002 | Olson |
| 6,451,732 B1 | 9/2002 | Beckett et al. |
| 6,451,735 B1 | 9/2002 | Ottaway et al. |
| 6,824,978 B1 | 11/2004 | Cox, III et al. |
| 6,933,113 B2 | 8/2005 | Case et al. |
| 6,979,539 B2 | 12/2005 | Cox, III et al. |
| 7,001,768 B2 | 2/2006 | Wolffe |
| 7,013,219 B2 | 3/2006 | Case et al. |
| 7,067,722 B2 | 6/2006 | Fillatti |
| 7,070,934 B2 | 7/2006 | Cox, III et al. |
| 7,163,824 B2 | 1/2007 | Cox, III et al. |
| 7,189,691 B2 | 3/2007 | Hemenway |
| 7,220,719 B2 | 5/2007 | Case et al. |
| 7,262,054 B2 | 8/2007 | Jamieson et al. |
| 7,273,923 B2 | 9/2007 | Jamieson et al. |
| 7,285,416 B2 | 10/2007 | Choo et al. |
| 7,361,635 B2 | 4/2008 | Miller et al. |
| 7,521,241 B2 | 4/2009 | Choo et al. |
| 7,842,489 B2 | 11/2010 | Arnould et al. |
| 8,420,782 B2 | 4/2013 | Bonas et al. |
| 8,440,431 B2 | 5/2013 | Voytas et al. |
| 8,440,432 B2 | 5/2013 | Voytas et al. |
| 8,450,471 B2 | 5/2013 | Voytas et al. |
| 8,586,363 B2 | 11/2013 | Voytas et al. |
| 8,697,853 B2 | 4/2014 | Voytas et al. |
| 9,035,129 B2 | 5/2015 | Bilyeu et al. |
| 9,198,365 B2 | 12/2015 | Bilyeu et al. |
| 2001/0016956 A1 | 8/2001 | Ward et al. |
| 2005/0064474 A1 | 3/2005 | Umov et al. |
| 2007/0141038 A1 | 6/2007 | Choulika et al. |
| 2009/0060921 A1 | 3/2009 | Dickey et al. |
| 2009/0133158 A1 | 5/2009 | Lahaye et al. |
| 2009/0271881 A1 | 10/2009 | Arnould et al. |
| 2009/0305402 A1 | 12/2009 | Liljedahl et al. |
| 2010/0132069 A1 | 5/2010 | Lahaye et al. |
| 2010/0154081 A1 | 6/2010 | Weterings et al. |
| 2011/0041195 A1 | 2/2011 | Doyon |
| 2011/0129898 A1 | 6/2011 | Doyon et al. |
| 2011/0136895 A1 | 6/2011 | Gregory et al. |
| 2011/0145940 A1 | 6/2011 | Voytas et al. |
| 2011/0158957 A1 | 6/2011 | Bonini et al. |

(Continued)

FOREIGN PATENT DOCUMENTS

| | | |
|---|---|---|
| CN | 1724669 | 1/2006 |
| CN | 102782140 | 11/2012 |

(Continued)

OTHER PUBLICATIONS

Pham et al. (Theor. Appl. Genet., 125:503-515; 2012).*

(Continued)

*Primary Examiner* — Vinod Kumar
(74) *Attorney, Agent, or Firm* — Fish & Richardson P.C.

(57) ABSTRACT

Materials and methods are provided for making soybean varieties that have altered oil composition as a result of mutations in the FAD3A, FAD3B, and FAD3C genes.

3 Claims, 12 Drawing Sheets

Specification includes a Sequence Listing.

(56) References Cited

U.S. PATENT DOCUMENTS

| | | |
|---|---|---|
| 2011/0167521 A1 | 7/2011 | DeKelver et al. |
| 2011/0201055 A1 | 8/2011 | Doyon et al. |
| 2011/0201118 A1 | 8/2011 | Yang et al. |
| 2011/0203012 A1 | 8/2011 | Dotson et al. |
| 2011/0207221 A1 | 8/2011 | Cost et al. |
| 2011/0239315 A1 | 9/2011 | Bonas et al. |
| 2011/0247089 A1 | 10/2011 | Doyon |
| 2011/0265198 A1 | 10/2011 | Gregory et al. |
| 2011/0269234 A1 | 11/2011 | Doyon et al. |
| 2011/0287545 A1 | 11/2011 | Cost et al. |
| 2011/0301073 A1 | 12/2011 | Gregory et al. |
| 2012/0102587 A1 | 4/2012 | Anai |
| 2012/0110685 A1 | 5/2012 | Bonas et al. |
| 2012/0122205 A1 | 5/2012 | Bonas et al. |
| 2012/0178131 A1 | 7/2012 | Voytas et al. |
| 2012/0178169 A1 | 7/2012 | Voytas et al. |
| 2012/0214228 A1 | 8/2012 | Voytas et al. |
| 2012/0246764 A1 | 9/2012 | Hlubek et al. |
| 2012/0284877 A1 | 11/2012 | Hlubek et al. |
| 2012/0324603 A1 | 12/2012 | Hlubek et al. |
| 2013/0122581 A1 | 5/2013 | Voytas et al. |
| 2014/0090116 A1 | 3/2014 | Ainley et al. |
| 2014/0370558 A1* | 12/2014 | Mathis .................. C12P 7/6445 435/134 |

FOREIGN PATENT DOCUMENTS

| | | | |
|---|---|---|---|
| EP | 0 242 246 | 10/1987 | |
| EP | 2 206 723 | 7/2010 | |
| EP | 2 392 208 | 12/2011 | |
| EP | 2 562 260 | 2/2013 | |
| WO | WO 1994/18313 | 8/1994 | |
| WO | WO 1995/09233 | 4/1995 | |
| WO | WO 2004/067736 | 8/2004 | |
| WO | WO 2007/060495 | 5/2007 | |
| WO | WO 2007/106728 | 9/2007 | |
| WO | WO 2008/141806 | 11/2008 | |
| WO | WO 2009/095793 | 8/2009 | |
| WO | WO 2010/079430 | 7/2010 | |
| WO | WO 2010/091018 | 8/2010 | |
| WO | WO 2010/145846 | 12/2010 | |
| WO | WO 2010/150901 | 12/2010 | |
| WO | WO 2011/005998 | 1/2011 | |
| WO | WO 2011/017293 | 2/2011 | |
| WO | WO 2011/019385 | 2/2011 | |
| WO | WO 2011/049627 | 4/2011 | |
| WO | WO 2011/072246 | 6/2011 | |
| WO | WO 2011/100058 | 8/2011 | |
| WO | WO 2011/117249 | 9/2011 | |
| WO | WO 2011/146121 | 11/2011 | |
| WO | WO 2011/154393 | 12/2011 | |
| WO | WO 2012/106105 | 8/2012 | |
| WO | WO 2013/050155 | 4/2013 | |
| WO | WO 2014/039684 | 3/2014 | |
| WO | WO 2014/039692 | 3/2014 | |
| WO | WO 2014/039702 | 3/2014 | |
| WO | WO-2014039684 A1 * | 3/2014 | ......... C12N 15/8247 |
| WO | WO 2014/141147 | 9/2014 | |

OTHER PUBLICATIONS

Chappell et al. (GenBank Sequence Accession No. EF175461, Published Apr. 15, 2007).*
Mahfouz et al. (Plant Biotechnology Journal, 12:1006-1014, Published 2014).*
U.S. Appl. No. 61/225,043, filed Jul. 13, 2009, Bonas et al.
"TAL effector nucleases," Nature Reprint Collection [online]. Oct. 2011, [retrieved on Mar. 14, 2012]. Retrieved from the Internet: URL <http://www.nature.com/nbt/collections/talen/index.html>, 32 pages, Marshall (ed.).
Alam and Sittman, "Characterization of the cytotoxic effect of a chimeric restriction enzyme, H1°-FokI," Gene Ther Mol Biol, 10:147-160, 2006.

Alam, "Characterization of the cytotoxic effect of a novel chimeric restriction nuclease, H1°-FokI, in mouse fibroblast cells: Implications for chromatin mapping and gene therapy studies," Ph.D. Thesis, The University of Mississippi Medical Center, 223 pages, 2006.
Al-Saadi et al., "All five host-range variants of Xanthomonas citri carry one pthA homolog with 17.5 repeats that determines pathogenicity on citrus, but none determine host-range variation," Mol Plant Microbe Interact, 20(8): 934-943, 2007.
Antony et al., "Rice xa13 recessive resistance to bacterial blight is defeated by induction of the disease susceptibility gene Os-11N3," Plant Cell, 22(11):3864-3876, 2010.
Antony, "Molecular basis of avrXa7 mediated virulence in bacterial blight of rice," [abstract of dissertation] Kansas State University, 99 pages, 2010.
Arimondo et al., "Exploring the cellular activity of camptothecin-triple-helix-forming oligonucleotide conjugates," Mol Cell Biol, 26:324-333, 2006.
Athinuwat et al., "Xanthomonas axonopodis pv. glycines soybean cultivar virulence specificity is determined by avrBs3 homolog avrXgl," Phytopathology, 99(8):996-1004, 2009.
Bachlava et al, "Mapping Genes Encoding Microsomal ω-6 Desaturase Enzymes and Their Cosegregation with QTL Affecting Oleate Content in Soybean," Crop Science., 48: 640-650, Mar.-Apr. 2008.
Bai et al., "Xanthomonas oryzae pv. oryzae avirulence genes contribute differently and specifically to pathogen aggressiveness," Mol Plant Microbe Interact, 13(12):1322-1329, 2000.
Baker, "Gene-editing nucleases," Nature Methods, 2012, 9:23-26.
Ballvora et al., "Genetic mapping and functional analysis of the tomato Bs4 locus governing recognition of the Xanthomonas campestris pv. vesicatoria AvrBs4 protein," Mol Plant Microbe Interact, 14(5):629-638, 2001.
Belahj et al., "Plant genome editing made easy: targeted mutagenesis in model and crop plants using the CRISPR/Cas system," Plant Methods, 9:39 (2013).
Beretta et al., "Tethering a type IB topoisomerase to a DNA site by enzyme fusion to a heterologous site-selective DNA-binding protein domain," Cancer Res, 59:3689-3697, 1999.
Bethke and Busse, "Validation of a simple, colorimetric, microplate assay using amplex red for the determination of glucose and sucrose in potato tubers and other vegetables," Am. J. Pot Res., 85:414-421 (2008).
Beuselinck et al., "An Assessment of Phenotype Selection for Linolenic Acid Using Genetic Markers," Crop Sci, 47:747-750 (2006).
Bhaskar et al., "Suppression of the vacuolar invertase gene prevents cold-induced sweetening in potato," Plant Physiol., 154(2):939-948 (Oct. 2010).
Bibikova et al., "Enhancing gene targeting with designed zinc finger nucleases," Science, 300(5620):764, 2003.
Bibikova et al., "Stimulation of homologous recombination through targeted cleavage by chimeric nucleases," Mol Cell Biol, 21(1): 289-297, 2001.
Bitinaite et al., "FokI dimerization is required for DNA cleavage," Proc Natl Acad Sci USA, 95:10570-10575, 1998.
Boch and Bonas. "Xanthomonas AvrBs3 family-type III effectors: discovery and function." Annu Rev Phytopathol, 48, 419-436, 2010.
Boch et al., "Breaking the code of DNA binding specificity of TAL-type III effectors," Science, 326:1509-1512, 2009.
Boch et al., "Molecular characterization of three AvrBs3-like effectors from the *Arabidopsis* pathogen Xanthomonas campestris pv. armoraciae," (abstract), XIV International Congress on Molecular Plant-Microbe Interactions, Quebec City, Canada, Jul. 19-23, 2009, 2 pages.
Bogdanove et al., "TAL effectors: Customizable Proteins for DNA Targeting," Science, 333: 1843-1846, 2011.
Bogdanove et al., "TAL effectors: finding plant genes for disease and defense," Curr Opin Plant Biol, 13:394-401, 2010.
Boller and He, "Innate immunity in plants: an arms race between pattern recognition receptors in plants and effectors in microbial pathogens," Science, 324:742-744, 2009.

(56) References Cited

OTHER PUBLICATIONS

Bolon et al., "Phenotypic and Genomic Analyses of a Fast Neutron Mutant Population Resource in Soybean1 [W][OA]," Plant Physiology., 156: 240-253, May 2011.
Bonas et al., "Resistance in tomato to Xanthomonas campestris pv vesicatoria is determined by alleles of the pepper-specific avirulence gene avrBs3," Mol Gen Genet, 328: 261-269, 1993.
Bonas et al., "Genetic and structural characterization of the avirulence gene avrBs3 from Xanthomonas campestris pv. Vesicatoria," Mol Gen Genet, 218:127-136, 1989.
Bonas et al., "How the bacterial plant pathogen Xanthomonas campestris pv. vesicatoria conquers the host," Mol Plant Pathol, 1(1):73-76, 2000.
Bonas et al., "Resistance in tomato to Xanthomonas campestris pv vesicatoria is determined by alleles of the pepper-specific avirulence gene avrBs3," Mol Gen Genet, 238(1-2):261-269, 1993.
Bonas, "How Xanthomonas manipulates the plant cell," (abstract), XIV International Congress on Molecular Plant-Microbe Interactions, Quebec City, Canada, Jul. 19-23, 2009, 2 pages.
Borevitz et al., "Activation tagging identifies a conserved MYB regulator of phenylpropanoid biosynthesis," Plant Cell, 12:2383-2394, 2000.
Busk, "Regulatory elements in vivo in the promoter of the abscisic acid responsive gene rab17 from maize," Plant J, 11:1285-1295, 1997.
Büttner and Bonas, "Getting across—bacterial type III effector proteins on their way to the plant cell," EMBO J, 2002, 21(20):5313-5322, 2002.
Büttner et al., "Functional analysis of HrpF, a putative type III translocon protein from Xanthomonas campestris pv. vesicatoria," J Bacteriol, 184(9):2389-2398, 2002.
Büttner et al., "HpaB from Xanthomonas campestris pv. vesicatoria acts as an exit control protein in type III-dependent protein secretion," Mol Microbiol, 54(3):755-768, 2004.
Büttner et al., "Targeting of two effector protein classes to the type III secretion system by a HpaC- and HpaB-dependent protein complex from Xanthomonas campestris pv. vesicatoria," Mol Microbiol, 59(2):513-527, 2006.
Canteros et al., "A gene from Xanthomonas campestris pv. vesicatoria that determines avirulence in tomato is related to avrBs3," Mol Plant Microbe Interact, 4(6):628-632, 1991.
Carlson et al., "Targeting DNA With Fingers and TALENs," Mol Ther Nucl Acids, 1:e3, doi:10.1038/mtna.2011.5, 4 pages, 2012.
Cathomen et al., "Zinc-finger nucleases: the next generation emerges," Mol Ther, 16(7):1200-1207, 2008.
Cavalier et al., "Disrupting Two *Arabidopsis thaliana* Xylosyltransferase Genes Results in Plant Deficient in Xyloglucan, a Major Primary Cell Wall Component," The Plant Cell, 20:1519-1537 (Jun. 2008).
Cermak et al., "Efficient design and assembly of custom TALEN and other TAL effector-based constructs for DNA targeting," Nucleic Acids Res, 39(12):e82, pp. 1-11, Apr. 14, 2011.
Cermak et al., Poster and Abstract—"Engineered TAL effector nucleases: new tools for genome editing," Northwest Genome Engineering Consortium Workshop on Genome Engineering, 3 pages, 2010.
Chevalier et al., "Design, activity, and structure of a highly specific artificial endonuclease," Mol Cell, 10(4):895-905, 2002.
Choo et al., "In vivo repression by a site-specific DNA-binding protein designed against an oncogenic sequences," Nature, 372(6507):642-645, 1994.
Choulika et al., "Induction of homologous recombination in mammalian chromosomes by using the I-SceI system of *Saccharomyces cerevisiae*," Mol Cell Biol, 15(4):1968-1973, 1995.
Christian et al., "Targeting DNA double-strand breaks with TAL effector nucleases," Genetics, 186:757-761 (2010).
Christian et al., Poster and Abstract—"Fusions of TAL effectors to the FokI endonuclease confer site specificity in DNA cleavage," IAPB 12th World Congress and In Vitro Biology Meeting, 4 pages, Jun. 2010.

Cole et al., "The Jpred 3 secondary structure prediction server," Nucl Acids Res, 36:W197-W201, 2008.
Cornelis, "The type III secretion injectisome," Nat Rev Microbiol, 4:811-825, 2006.
Curtin et al., "Targeted mutagenesis of duplicated genes in soybean with zinc-finger nucleases," Plant Physiology, 156(2):466-473 (2011).
Database Geneseq [Online] Feb. 5, 2009 (Feb. 5, 2009), "Soybean FAD3-1C gene, SEQ ID 62," retrieved from EBI accession No. GSN:AUM14321, 2 pages.
De Feyter et al., "Gene-for genes interactions between cotton R genes and Xanthomonas campestris pv. malvacearum avr genes," Mol Plant Microbe Interact, 6(2):225-237, 1993.
Defrancesco, "Move over ZFNs," Nat Biotechnol, 29: 681-684, 2011.
Demorest et al., "Direct stacking of sequence-specific nuclease-induced mutations to produce high oleic and low linolenic soybean oil," BMC Plant Biology., 16(1): Oct. 13, 2016, pp. 2-4.
Desjarlais and Berg, "Toward rules relating zinc finger protein sequences and DNA binding site preferences," Proc Natl Acad Sci USA, 89:7345-7349, 1992.
Domingues et al., "The Xanthomonas citri effector protein PthA interacts with citrus proteins involved in nuclear transport, protein folding and ubiquitination associated with DNA repair," Mol Plant Pathol, 11(5):663-675, DOI : 10.1111/ J .1364-3703.2010.00636.X, 13 pages, 2010.
Doyle et al., "TAL Effector-Nucleotide Targeter (TALE-NT) 2.0: tools for TAL effector design and target prediction," Nucleic Acids Res, 40:W117-122 (2012).
Draffehn et al., "Natural diversity of potato (*Solanum tuberosum*) invertases," BMC Plant Biol., 10:271, 15 pages (2010).
Durai et al., "Zinc finger nucleases: custom-designed molecular scissors for genome engineering of plant and mammalian cells," Nucl Acids Res, 33(1): 5978-5990, 2005.
Eisenschmidt et al., "Developing a programmed restriction endonuclease for highly specific DNA cleavage," Nucl Acids Res, 33:7039-7047, 2005.
Engler et al. "A One Pot, One Step, Precision Cloning Method with High Throughput Capability," PLoS One, 3: e3647, 7 pages, 2008.
Engler et al., "Golden Gate Shuffling: A One-Pot DNA Shuffling Method Based on Type IIs Restriction Enzymes," PLoS One, 4:e5553, 9 pages, 2009.
Fajardo-Sanchez et al., "Computer design of obligate heterodimer meganucleases allows efficient cutting of custom DNA sequences," Nucl Acids Res, 36(7):2163-2173, 2008.
Foley et al., "Rapid Mutation of Endogenous Zebrafish Genes Using Zinc Finger Nucleases Made by Oligomerized Pool ENgineering (OPEN)," PLoS One, 13 pages, 4:e4348, 2009.
Fonfara et al., "Creating highly specific nucleases by fusion of active restriction endonucleases and catalytically inactive homing endonucleases," Nucl Acids Res, 40(2):847-860, 2011.
Fujikawa et al., "Suppression of defense response in plants by the avrBs3/pthA gene family of *Xanthomonas* spp," Mol Plant Microbe Interact, 19(3):342-349, 2006.
Gabriel et al.,"An unbiased genome-wide analysis of zinc-finger nuclease specificity," Nat Biotechnol, 29:816-823, 2011.
Garba et al., "Review on Fatty Acid Desaturases and their Roles in Temperature Acclimatisation," J. Applied Sci., 17(6):282-295, 2017.
Geißler et al., "Transcriptional activators of human genes with programmable DNA-specificity," PLoS One, 6(5):e19509, May 2011.
GenBank Accession No. AAT46122, Nov. 12, 2004, 2 pages.
GenBank Accession No. ACD58243, May 19, 2008, 2 pages.
GenBank Accession No. AY986492, Jun. 24, 2005, 2 pages.
GenBank Accession No. CP000967, GI: 188518722, May 19, 2008, 606 pages.
GenBank Accession No. J04623, Apr. 26, 1993, 2 pages.
GenBank Accession No. M28828, Apr. 26, 1993, 3 pages.
GenBank Accession No. P14727, Jun. 28, 2011, 3 pages.
GenBank Accession No. X16130, Oct. 15, 2007, 3 pages.
Goettel et el., "Identification and characterization of large DNA deletions affecting oil quality traits in soybean seeds through transcriptome sequencing analysis," Theor Appl Genet., 129: 1577-1593, 2016.

(56) References Cited

OTHER PUBLICATIONS

Göhre and Robatzek, "Breaking the barriers: microbial effector molecules subvert plant immunity," Ann Rev Phytopathol, 46:189-215, 2008.
Gonchar et al., PspXI, a novel restriction endonuclease that recognizes the unusual DNA sequence 5'-VC↓TCGAGB-3', Bulletin of biotechnology and physico-chemical biology, 1(1):18-24, 2005, Translation by Ovchinnikov, "Science sibenzyme.com" [online], [retrieved on Aug. 11, 2011]. Retrieved from the Internet: URL: <http://science.sibenzyme.com/article8_article_3_1.phtml>, 4 pages.
Gonzalez et al., "Molecular and pathotypic characterization of new Xanthomonas oryzae strains from West Africa," Mol Plant Microbe Interact, 20(5):534-546, 2007.
Govindarajulu et al., "Evaluation of constitutive viral promoters in transgenic soybean roots and nodules," Mol. Plant Microbe Interact, 21:1027-1035 (2008).
Greiner et al., "Ectopic expression of a tobacco invertase inhibitor homolog prevents cold-induced sweetening of potato tubers," Nature Biotechnology, 17(7):708-711 (1999).
Greisman and Pabo, "A general strategy for selecting high-affinity zinc finger proteins for diverse DNA target sites," Science, 275(5300):657-661, 1997.
Gu et al., "R gene expression induced by a type-III effector triggers disease resistance in rice," Nature, 435:1122-1125 (2005).
Gu et al., "Transcription activator-like type III effector AvrXa27 depends on OsTFIIAgamma5 for the activation of Xa27 transcription in rice that triggers disease resistance to Xanthomonas oryzae pv. oryzae," Mol Plant Pathol, 10(6):829-835, 2009.
Guan et al., "Heritable endogenous gene regulation in plants with designed polydactyl zinc finger transcription factors," Proc Natl Acad Sci USA, 99(20):13296-13301, 2002.
Guo et al., "Protein tolerance to random amino acid change," Proc. Natl. Acad. Sci. USA, 101(25): 9205-9210, 2004.
Gürlebeck et al., "Dimerization of the bacterial effector protein AvrBs3 in the plant cell cytoplasm prior to nuclear import," Plant J, 42:175-187, 2005.
Gürlebeck et al., "Type III effector proteins from the plant pathogen Xanthomonas and their role in the interaction with the host plant," J Plant Physiol, 163(3):233-255, 2006 (Epub 2005).
Gürlebeck et al., "Visualization of novel virulence activities of the Xanthomonas type III effectors AvrBs1, AvrBs3, and AvrBs4," Mol Plant Pathol, 10(2):175-188, 2009.
Haber, "In vivo biochemistry: Physical monitoring of recombination induced by site-specific endonucleases," Bioessays, 17:609-620, 1995.
Haberlach et al., "Isolation, culture and regeneration of protoplasts from potato and several related *Solanum* species," Plant Science, 39:67-74 (1985).
Hahn et al., "New mechanistic insights into the virulence activity of the Xanthomonas type III effector AvrBs3," (abstract), XIV International Congress on Molecular Plant-Microbe Interactions, Quebec City, Canada, Jul. 19-23, 2009, 2 pages.
Halford et al., "The reaction mechanism of FokI excludes the possibility of targeting zinc finger nucleases to unique DNA sites," Biochem Soc Trans, 39:584-588, 2011.
Handel et al., "Expanding or restricting the target site repertoire of zinc-finger nucleases: the inter-domain linker as a major determinant of target site selectivity," Mol Ther, 17:104-111, 2009.
Haun et al., "Improved soybean oil quality by targeted mutagenesis of fatty acid desaturase 2 gene family," Plant Biotechnology Journal, 12(7):934-940, 2014.
Herbers et al., "Race-specificity of plant resistance to bacterial spot disease determined by repetitive motifs in a bacterial avirulence protein," Nature, 356:172-174, 1992.
Heuer et al., "Repeat domain diversity of avrBs3-like genes in Ralstonia solanacearum strains and association with host preferences in the field," Appl Environ Microbiol, 73(13):4379-4384, 2007.

Hill et al., "Functional analysis of conserved histidines in ADP-glucose pyrophosphorylase from *Escherichia coli*," Biochem. Biophys. Res. Comm., 1998, 244: 573-577.
Hockemeyer et al., "Genetic engineering of human pluripotent cells using TALE nucleases," Nat Biotechnol, 29(8):731-734, 2011.
Hopkins et al., "Identification of a family of avirulence genes from Xanthomonas oryzae pv. oryzae," Mol Plant Microbe Interact, 5(6):451-459, 1992.
Hoshino et al., "Novel GmFAD2-1b mutant alleles created by reverse genetics induce marked elevation of oleic acid content in soybean seeds in combination with GmFAD2-1a mutant alleles," Breeding Science., 60:419-425, 2010.
Hu et al., "A virulence gene and insertion element-based RFLP as well as RAPD markers reveal high levels of genomic polymorphism in the rice pathogen Xanthomonas oryzae pv. oryzae," Syst Appl Microbiol, 30:587-600, 2007.
Huang et al., "Heritable gene targeting in zebrafish using customized TALENs," Nat Biotechnol, 29(8):699-700, 2011.
Hummel et al., "Rice gene activation by transcription activator-like effectors of Xanthomonas oryzae pvs. oryzae and myzicola," poster presentation, and "A cipher-like mechanism governs TAL effector-DNA recognition," poster #13-517, XIV International Congress on Molecular Plant-Microbe Interactions, Quebec City, Canada, 3 pages, Jul. 19-23, 2009.
Hurt et al., "Highly specific zinc finger proteins obtained by directed domain shuffling and cell-based selection," Proc Natl Acad Sci USA, 100(21):12271-12276, 2003.
International Preliminary Report on Patentability in International Application No. PCT/IB2017/050574, dated Aug. 16, 2018, 13 pages.
International Search Report and Written Opinion in International Application No. PCT/IB2014/059752, dated Jul. 29, 2014, 16 pages.
International Search Report and Written Opinion in International Application No. PCT/IB2017/050574, dated Jun. 1, 2017, 22 pages.
Invitation to Pay Additional Fees in International Application No. PCT/IB2017/050574, dated Apr. 10, 2017, 12 pages.
Isalan et al., "A rapid, generally applicable method to engineer zinc fingers illustrated by targeting the HIV-1 promoter," Nat Biotechnol, 19(7):656-660, 2001.
Jackel et al., "Protein design by directed devolution," Annu Rev Biophys, 37:155-173, 2008.
Jones and Dangl, "The plant immune system," Nature, 444:323-329, 2006.
Jordan et al., "Physical delimitation of the pepper Bs3 resistance gene specifying recognition of the AvrBs3 protein from Xanthomonas campestris pv. vesicatoria," Theor Appl Genet, 113(5):895-905, 2006.
Kay and Bonas, "How Xanthomonas type III effectors manipulate the host plant," Curr Opin Microbiol, 12:37-43, 2009.
Kay et al., "A bacterial effector acts as a plant transcription factor and induces a cell size regulator," Science, 318:648-651 (2007).
Kay et al., "Bacterial Effector Acts as a Plant Transcription Factor and Induces a Cell Size Regulator," Science, 318(5850):648-651, 2007.
Kay et al., "Characterization of AvrBs3-like effectors from a Brassicaceae pathogen reveals virulence and avirulence activities and a protein with a novel repeat architecture," Mol Plant Microbe Interact, 18(8):838-848, 2005.
Kay et al., "Detailed analysis of the DNA recognition motifs of the Xanthomonas type III effectors AvrBs3 and AvrBs3deltarep16," Plant J, 59(6):859-871, 2009.
Kebede et al., "A new gene that controls seed coat wrinkling in soybean," Euphytica., 189:309-320, 2013.
Keshavarzi et al., "Basal defenses induced in pepper by lipopolysaccharides are suppressed by Xanthomonas campestris pv. vesicatoria," Mol Plant Microbe Interact, 17(7):805-815, 2004.
Kim and Chandrasegaran, "Chimeric restriction endonuclease," Proc Natl Acad Sci USA, 91(3):883-887 (Feb. 1994).
Kim et al., "Comparative analysis of three indigenous plasmids from Xanthomonas axonopodis pv. glycines," Plasmid, 56(2):79-87, 2006.

(56) References Cited

OTHER PUBLICATIONS

Kim et al., "Construction of a Z-DNA-specific restriction endonuclease," Proc Natl Acad Sci USA, 94(24):12875-12879, 1997.
Kim et al., "Hybrid restriction enzymes: zinc finger fusions to FokI cleavage," Proc Natl Acad Sci USA, 93:1156-1160, 1996.
Kim et al., "Site-specific cleavage of DNA-RNA hybrids by zinc finger/FokI cleavage domain fusions," Gene, 203(1):43-49, 1997.
Kim et al., "Targeted genome editing in human cells with zinc finger nucleases constructed via modular assembly," Genome Res, 19:1279-1288 (2009).
Knoop et al., "Expression of avirulence gene avrBs3 from Xanthomonas campestris pv. vesicatoria is not under the control of hrp genes and is independent of plant factors," J Bacteriol, 173(22):7142-7150, 1991.
Lahaye and Bonas, "Molecular secrets of bacterial type III effector proteins," Trends Plant Sci, 6(10):479-485, 2001.
Ledford, "Plant genes get fine tailoring," Nature News [online], Apr. 29, 2009 [retrieved on May 21, 2009]. Retrieved from the Internet: <URL: http://www.nature.com/news/2009/090429/full/news.2009.415.html>, 3 pages.
Lee et al., "Environmental Effects on Oleic Acid in Soybean Seed Oil of Plant Introductions with Elevated Oleic Concentration," Crop Science, 49:1762-1768 (Sep./Oct. 2009).
Li et al., "Functional domains in FokI restriction endonuclease," Proc Natl Acad Sci USA, 89(10):4275-4279, 1992.
Li et al., "Modularly assembled designed TAL effector nucleases for targeted gene knockout and gene replacement in eukaryotes," Nucl Acids Res, 39:6315-6325, 2011.
Li et al., "TAL nucleases (TALNs): hybrid proteins composed of TAL effectors and FokI DNA-cleavage domain," Nucleic Acids Research, 39(1):359-372, 2010.
Liang et al., "Cloning and characterization of a novel avirulence gene (arp3) from Xanthomonas oryzae pv. oryzae," DNA Seq, 15(2):110-117, 2004.
Liu et al., "Design of polydactyl zinc-finger proteins for unique addressing within complex genomes," Proc Natl Acad Sci USA, 94(11):5525-5530, 1997.
Livak and Schmittgen, "Analysis of relative gene expression data using real-time quantitative PCR and the 2(-Delta Delta C(T)) Method," Method. Methods, 25:402-408 (2001).
Mahfouz et al., "Genome engineering via Talens and CRISPR/Cas9 systems: challenges and prospectives," Plant Biotechnol J., 12(8):1006-1014, Sep. 24, 2014.
Mahfouz et al., "De novo-engineered transcription activator-like effector (TALE) hybrid nuclease with novel DNA binding specificity creates double-strand breaks," Proc Natl Acad Sci USA, 108:2623-2628, 2011.
Mahfouz et al., "TALE nucleases and next generation GM crops," GM Crops, 2(2):99-103 (Apr. 2011).
Mak, "Sequence-specific DNA-binding TALEs," Nat Biotechnol, 29:43, 2011.
Marois et al., "The xanthomonas type III effector protein AvrBs3 modulates plant gene expression and induces cell hypertrophy in the susceptible host," Mol Plant Microbe Interact, 15(7):637-646, 2002.
Miller et al., "A TALE nuclease architecture for efficient genome editing," Nat Biotechnol, 29:143-148, 2011.
Miller et al., "An improved zinc-finger nuclease architecture for highly specific genome editing," Nature Biotechnol, 25:778-785, 2007.
Minczuk et al., "Development of a single-chain, quasi-dimeric zinc-finger nuclease for the selective degradation of mutated human mitochondrial DNA," Nucleic Acids Res, 36(12):3926-3938, 2008.
Mino et al., "Efficient double-stranded DNA cleavage by artificial zinc-finger nucleases composed of one zinc-finger protein and a single-chain FokI dimer," J Biotechnol, 140(3-4):156-161, 2009.
Moore et al., "Transactivated and chemically inducible gene expression in plants," Plant J, 45:651-683, 2006.
Morbitzer et al., "Assembly of custom TALE-type DNA binding domains by modular cloning," Nucleic Acids Research, 39(13):5790-5799, 2011.
Morbitzer et al., "Regulation of selected genome loci using de novo-engineered transcription activator-like effector (TALE)-type transcription factors," Proc Natl Acad Sci U S A., 107(50):21617-21622, 2010.
Moscou and Bogdanove, "A Simple Cipher Governs DNA Recognition by TAL Effectors," Science 326(5959): 1501, 2009.
Murakami et al., "The repeat domain of the type III effector protein PthA shows a TPR-like structure and undergoes conformational changes upon DNA interaction," Proteins, 78:3386-3395, 2010.
Murray et al., "Rapid isolation of high molecular weight plant DNA," Nucl. Acids Res, 8(19):4321-4325 (1980).
Mussolino et al., "A novel TALE nuclease scaffold enables high genome editing activity in combination with low toxicity," Nucleic Acids Res, 39:9283-9293 (2011).
Nakagawa et al., "Development of series of gateway binary vectors, pGWBs, for realizing efficient construction of fusion genes for plant transformation," J Biosci Bioeng, 104:34-41, 2007.
Niño-Liu et al., "Xanthomonas oryzae pathovars: model pathogens of a model crop," Mol Plant Pathol, 7(5):303-324, 2006.
Nissan et al. "The type III effectors HsvG and HsvB of gall-forming Pantoea agglomerans determine host specificity and function as transcriptional activators." Molecular Microbiology, 61(5): 1118-1131, 2006.
Noël et al., "XopC and XopJ, two novel type III effector proteins from Xanthomonas campestris pv. vesicatoria," J Bacteriol, 185(24):7092-7102, 2003.
Ovchinnikov et al., "PspXI, a novel restriction endonuclease that recognizes the unusual DNA sequence 5-VCTCGAGB-3," Bull Biotech Physio-Chemical Biol, 2005, 1(1):18-24, retrieved from the Internet: http://science.sibenzyme.com/article8_article_3_1.phtml.
Padidam, "Chemically regulated gene expression in plants," Curr Opin Plant Biol, 6:169-177, 2003.
Paques and Duchateau, "Meganucleases and DNA Double-Strand Break-Induced recombination: Perspectives for Gene Therapy," Curr Gene Ther, 7:49-66, 2007.
Park et al., "Avirulence gene diversity of Xanthomonas axonopodis pv. Glycines isolated in Korea," J Microbiol Biotechnol, 18(9):1500-1509, 2008.
Pattanayak et al., "Revealing off-target cleavage specificities of zinc-finger nucleases by in vitro selection," Nat Methods, 8:765-770, 2011.
Paulus et al., "Silencing β1,2-xylosyltransferase in transgenic tomato fruits reveals xylose as constitutive component in IgE-binding epitopes," Frontiers in Plant Science, 2(42), 12 pages (Aug. 2011).
Pavletich and Pabo, "Zinc finger-DNA recognition: crystal structure of a Zif268-DNA complex at 2.1 A," Science, 252:809-817, 1991.
Pearson, "The fate of fingers," Nature, 455:160-164, 2008.
Pennisi, "The Tale of the TALES," Science, 338(6113):1408-1411, 2012.
Pham et al., "Combinations of mutant FAD2 and FAD3 genes to produce high oleic acid and low linolenic acid soybean oil," Theoretical and Applied Genetics., 125(3):503-515, Apr. 4, 2012.
Pham et al., "A novel FAD2-1A allele in a soybean plant introduction offers an alternate means to produce soybean seed oil with 85% oleic acid content," Theoretical and Applied Genetics, Jun. 2011, 123(5):793-802.
Pham et al., "Mutant alleles of FAD2-1A and FAD2-1B combine to produce soybeans with the high oleic acid seed oil trait," BMC Plant Biol., 10:195, Sep. 9, 2010.
Pingoud and Silva, "Precision genome surgery," Nature Biotechnol, 25(7):743-744, 2007.
Podhajska and Szybalski, "Conversion of the FokI endonuclease to a universal restriction enzyme: cleavage of phage M13mp7 DNA at predetermined sites," Gene, 40(2-3):175-182, 1985.
Pomerantz et al., "Structure-based design of transcription factors," Science, 267(5194):93-96, 1995.
Porteus and Baltimore, "Chimeric nucleases stimulate gene targeting in human cells," Science, 300:763, 2003.
Porteus and Carroll, "Gene targeting using zinc finger nucleases," Nature Biotechnol, 23:967-973, 2005.
Porteus, "Zinc fingers on target," Nature, 459: 337-338, 2009.

(56) References Cited

OTHER PUBLICATIONS

Potenza et al., "Targeting transgene expression in research, agricultural, and environmental applications: Promoters used in plant transformation," In vitro Cell Dev Biol, 40(1):1-22, 2004.
Puchta et al., "Homologous recombination in plant cells is enhanced by in vivo induction of double strand breaks into DNA by a site-specific endonuclease," Nucl Acids Res, 21(22):5034-5040, 1993.
Radecke et al., "Zinc-finger nuclease-induced gene repair with oligodeoxynucleotides: wanted and unwanted target locus modifications," Mol Ther, 18(4):743-753, 2010.
Reyon et al., "FLASH assembly of TALENs for high-throughput genome editing," Nat Biotechnol, 30:460-465 (2012).
Römer et al., "Plant pathogen recognition mediated by promoter activation of the pepper Bs3 resistance gene," Science, 318(5850):645-648 (2007).
Römer et al., "A single plant resistance gene promoter engineered to recognize multiple TAL effectors from disparate pathogens," Proc Natl Acad Sci USA, 106(48):20526-31, 2009.
Römer et al., "Promoter elements of rice susceptibility genes are bound and activated by specific TAL effectors from the bacterial blight pathogen, Xanthomonas oryzae pv. oryzae," New Phytol, 187:1048-1057, 2010.
Römer et al., "Recognition of AvrBs3-Like Proteins Is Mediated by Specific Binding to Promoters of Matching Pepper Bs3 Alleles," Plant Physiol, 150:1697-1712, 2009.
Romero et al., "Temperature Sensitivity of the Hypersensitive Response of Bell Pepper to Xanthomonas axonopodis pv. vesicatoria," Phytopathology, 92(2):197-203, 2002.
Rossier et al., "HrpB2 and HrpF from Xanthomonas are type III-secreted proteins and essential for pathogenicity and recognition by the host plant," Mol Microbiol, 38(4):828-838, 2000.
Rossier et al., "The Xanthomonas Hrp type III system secretes proteins from plant and mammalian bacterial pathogens," Proc Natl Acad Sci USA, 96(16):9368-9373, 1999.
Rouet et al., "Expression of a site-specific endonuclease stimulates homologous recombination in mammalian cells," Proc Natl Acad Sci USA, 91(13):6064-6068, 1994.
Rouet et al., "Introduction of double-strand breaks into the genome of mouse cells by expression of a rare-cutting endonuclease," Mol Cell Biol, 14(12):8096-8106, 1994.
Rybak et al., "Identification of *Xanthomonas citri* ssp. *citri* host specificity genes in a heterologous expression host," Mol Plant Pathol, 10(2):249-262, 2009.
Sandhu et al., "Enhanced oleic acid content in the soybean mutant M23 is associated with the deletion in the Fad2-1a gene encoding a fatty acid desaturase," JAOCS, 84:229-235 (2007).
Santiago et al., "Targeted gene knockout in mammalian cells by using engineered zinc-finger nucleases," Proc Natl Acad Sci USA, 105(15):5809-5814, 2008.
Scherder et al., "Agronomic and Seed Characteristics of Soybean Lines with Increased Oleate Content," Crop Science., 48: 1755-1758, Sep.-Oct. 2008.
Scholze and Boch, "TAL effectors are remote controls for gene activation," Curr Opin Microbiol, 14:47-53, 2011.
Scholze and Boch, "TAL effector-DNA specificity," Virulence, 1(5):428-432, 2010.
Schornack et al., "Characterization of AvrHah1, a novel AvrBs3-like effector from Xanthomonas gardneri with virulence and avirulence activity," New Phytol, 179:546-556, 2008.
Schornack et al., "Expression levels of avrBs3-like genes affect recognition specificity in tomato Bs4—but not in pepper BS3-mediated perception," Mol Plant-Microbe Interact, 18(11):1215-1225, 2005.
Schornack et al., "Gene-for-gene-mediated recognition of nuclear-targeted AvrBs3-like bacterial effector proteins," J. Plant Physiol, 163:256-272 (2006).
Schornack et al., "The tomato resistance protein Bs4 is a predicted non-nuclear TIR-NB-LRR protein that mediates defense responses to severely truncated derivatives of AvrBs4 and overexpressed AvrBs3," Plant J, 37(1):46-60, 2004.
Segal et al., "Endonuclease-induced, targeted homologous extrachromosomal recombination in Xenopus oocytes," Proc Natl Acad Sci USA, 92(3):806-810, 1995.
Sera, "Inhibition of virus DNA replication by artificial zinc finger proteins," J Virol, 79(4):2614-2619, 2005.
Shepard and Totten, "Mesophyll cell protoplasts of potato: isolation, proliferation, and plant regeneration," Plant Physiol., 60:313-316(1977).
Shukla et al., "Precise genome modification in the crop species *Zea mays* using zinc-finger nucleases," Nature, 459(7245):437-441, 2009.
Simon et al., "Targeting DNA with triplex-forming oligonucleotides to modify gene sequence," Biochimie, 90:1109-1116, 2008.
Skipper, "Technology: The holy grail for plant biologists," Nature Reviews Genetics, 10(6):350, 2009.
Strasser et al., "Generation of glycol-engineered Nicotiana bethamiana for the production of monoclonal antibodies with a homogeneous human-like N-glycan structure," Plant Biotechnology Journal, 6:392-402 (2008).
Studholme et al., "Genome-wide sequencing data reveals virulence factors implicated in banana Xanthomonas wilt," FEMS Microbiol Lett., 310(2):182-192, 2010.
Sugio et al., "Two type III effector genes of Xanthomonas oryzae pv. oryzae control the induction of the host genes OsTFIIAgamma1 and OsTFX1 during bacterial blight of rice," Proc Natl Acad Sci USA, 104:10720-10725 (2007).
Swarup et al., "An Xanthomonas citri pathogenicity gene, pthA, pleiotropically encodes gratuitous avirulence on nonhosts," Mol Plant Microbe Interact, 5(3):204-213, 1992.
Szurek et al. "Type III-dependent translocation of the Xanthomonas AvrBs3 protein into the plant cell," Mol Microbiol, 46(1): 13-23, 2002.
Szurek et al., "Eukaryotic features of the Xanthomonas type III effector AvrBs3: protein domains involved in transcriptional activation and the interaction with nuclear import receptors from pepper," Plant J, 26(5):523-534, 2001.
Takenaka et al., "Inhibition of tomato yellow leaf curl virus replication by artificial zinc-finger proteins," Nucl Acids Symposium Series, 51(1):429-430, 2007.
Thieme et al., "New type III effectors from Xanthomonas campestris pv. vesicatoria trigger plant reactions dependent on a conserved N-myristoylation motif," Mol Plant Microbe Interact, 20(10):1250-1261, 2007.
Thierry et al., "Cleavage of yeast and bacteriophage T7 genomes at a single site using the rare cutter endonuclease I-Sce I," Nucl Acids Res, 19(1):189-190, 1991.
Tovkach et al., "A toolbox and procedural notes for characterizing novel zinc finger nucleases for genome editing in plant cells," Plant J, 57:747-757, 2009.
Townsend et al., "High-frequency modification of plant genes using engineered zinc-finger nucleases," Nature, 459:442-445, 2009.
Urnov et al., "Highly efficient endogenous human gene correction using designed zinc-finger nuclease," Nature, 435(7042):646-651, 2005.
Van Den Ackerveken et al., "Recognition of the bacterial avirulence protein AvrBs3 occurs inside the host plant cell," Cell, 87(7):1307-1316, 1996.
Van Den Elzen et al., "A chimaeric hygromycin resistance gene as a selectable marker in plant cells," Plant Molecular Biology, 5:299-302 (1985).
Vergunst et al., "VirB/D4-Dependent Protein Translocation from Agrobacterium into Plant Cells," Science, 290:979-982, 2000.
Voytas et al., "Plant science. DNA binding made easy," Science, 326(5959):1491-1492, 2009.
Wah et al., "Structure of FokI has implications for DNA cleavage," Proc Natl Acad Sci USA, 95(18):10564-10569, 1998.
Wah et al., "Structure of the multimodular endonuclease FokI bound to DNA," Nature, 388(3):97-100, 1997.

(56) References Cited

OTHER PUBLICATIONS

Wang et al., "Chemically regulated expression systems and their applications in transgenic plants," Transgenic Res, 12:529-540, 2003.
Weber et al., "The type III-dependent Hrp pilus is required for productive interaction of Xanthomonas campestris pv. vesicatoria with pepper host plants," J Bacteriol, 187(7):2458-2468, 2005.
White and Yang, "Host and pathogen factors controlling the rice/ Xanthomonas oryzae interaction," Plant Physiol, 150:1677-1686, 2009.
White et al., "The type III effectors of Xanthomonas," Mol Plant Pathol, 10:749-766, 2009.
Wright et al., "High-frequency homologous recombination in plants mediated by zinc-finger nucleases," Plant J, 44:693-705 (2005).
Yang and White, "Diverse members of the AvrBs3/PthA family of type III effectors are major virulence determinants in bacterial blight disease of rice," Mol Plant Microbe Interact, 17(11):1192-1200, 2004.
Yang et al. "The virulence factor AvrXa7 of Xanthomonas oryzae of Oiyzae is a type III secretion pathway-dependent nuclear-localized double stranded DNA binding protein," Proc Natl Acad Sci USA, 97(17): 9807-9812, 2000.
Yang et al., "Avoidance of host recognition by alterations in the repetitive and C-terminal regions of AvrXa7, A type III effector of Xanthomonas oryzae pv. oryzae," Mol Plant Microbe Interact, 18(2):142-149, 2005.
Yang et al., "Os8N3 is a host disease-susceptibility gene for bacterial blight of rice," Proc Natl Acad Sci USA, 103:10503-10508 (2006).
Yoo et al., "*Arabidopsis* mesophyll protoplasts: a versatile cell system for transient gene expression analysis," Nature Protocols, 2:1565-1572 (2007).
Yuan et al., "Characterization of Xanthomonas oryzae-responsive cis-acting element in the promoter of rice race-specific susceptibility gene Xa13," Mol Plant, 4(2):300-309, 2011.
Zhang et al., "Efficient construction of sequence-specific TAL effectors for modulating mammalian transcription.," Nat Biotechnol, 29:149-153 (2011).
Zhang et al., "High frequency targeted mutagenesis in *Arabidopsis thaliana* using zinc finger nucleases," Proc Natl Acad Sci USA, 107(26):12028-12033 (2010).
Zhang et al., "RNAi effects on regulation of endogenous acid invertase activity in potato (*Solanum tuberosum* L.) tubers," Chin J Agric. Biotechnol, 5:107-111 (2008).
Zhu et al., "The C terminus of AvrXa10 can be replaced by the transcriptional activation domain of VP16 from the herpes simplex virus," Plant Cell, 11(9):1665-1674, 1999.
Zhu et al., "AvrXa10 Contains an Acidic Transcriptional Activation Domain in the Functionally Conserved C Terminus," Molecular Plant-Microbe Interactions, 11(8): 824-832, 1998.
Zhu et al., "The rsma-like gene rsmA(XOO) of Xanthomonas oryzae pv. oryzae regulates bacterial virulence and production of diffusible signal factor," Mol Plant Pathol, 12(3):227-237, 2011, Epub 2010.
Zou et al., "Identification of an avirulence gene, avrxa5, from the rice pathogen Xanthomonas oryzae pv. oryzae," Sci China Life Sci, 53(12):1440-1449, 2010.
Zrenner et al., "Soluble acid invertase determines the hexos-to sucrose ratio in cold-stored potato tubers," Planta, 198(2):246-252 (1996).
Zuo and Chua, "Chemical-inducible systems for regulated expression of plant genes," Curr Opin Biotechnol, 11:146-151, 2000.
Zuo et al., "Technical advance: An estrogen receptor-based transactivator XVE mediates highly inducible gene expression in transgenic plants," Plant J. 24:265-273 (2000).

* cited by examiner

FIG. 1

FAD3A_T01
ATGGTTAAAGACACAAAGCCTTTAGCCTATGCTGCTAATAATGGATACCAAAAGGAAGCTTTTGATCCTCCTCCACCGTTTAAGATTGCA
GAAATCAGAGTTGCAATACAGTTGCTGGGTCAAGAATCCATGGAGATCCCTCAGTTATGTTCTCAGGGATGTGCTTGTAATTGCTGCATTG
ATGGCTGCTGCAAGTCACTTCAACAACTGCTTCTCTGGCTAATCTATTGGCCCATTCAAGGAACAATGTTCTGGGCTCTGTTTGTTCTTGGACAT
GATTGGTAATTAATTTGTTGTTACTTTTTTTTTGCTTTATAATATGAATCTCACACACTGCTTTGTTATGCCTAATGAATCTTCACATTGGCTTTAGAC
AACTTAAATTTGAGATCTTTATTGTTTATGTTTTTTGCTTTATATGGTAAAGTAATTCCTCAATTCTTGTGCCATACCAAAATAATGAAATCTGAAAGTTATAA
ACAGCCCTTTTCTAAATAGCCTGGTGGACACATCTTGCATTCCTCAATTCTTGTGCCATACAGAAAAATAATGAAATCTGAAAGTTATAA
GTCATTGGAAGTTCTTTATTGCATTGAAAGTTCTTTTATTAATTTTCTTTATTAAACTTTTTATATTTAATCACATTTGATGTTGGAACCAAGTTGATTTTGATG
CTTTAGCTTCATTGCATTGAAAGTTCTTTTATTAATTTTCTTTATTAAACTTTGATGGAACCAATCACATTTGATGTGGAACCAAGTTGATTTTGATG
GTAAAGTTATAACTATTAACTTTTGACTAAACTCACCATCAAACTCATGGACACATTGAGAAGGATGAATCCTGGGTTCCA (SEQ ID NO:1)
GATTTTGCAGGAGAATTAGCCACAGAACTCACCATCAAACTCAAAATCATGGACACATTGAGAAGGATGAATCCTGGGTTCCA (SEQ ID NO:1)

FAD3A_T02
ATGGTTAAAGACACAAAGCCTTTAGCCTATGCTGCTAATAATGGATACCAAAAGGAAGCTTTTGATCCTCCTCCACCGTTTAAGATTGCA
GAAATCAGAGTTGCAATACAGTTGCTGGGTCAAGAATCCATGGAGATCCCTCAGTTATGTTCTCAGGGATGTGCTTGTAATTGCTGCATTG
ATGGCTGCTGCAAGTCACTTCAACAACTGCTTCTCTGGCTAATCTATTGGCCCATTCAAGGAACAATGTTCTGGGCTCTGTTTGTTCTTGGACAT
GATTGGTAATTAATTTGTTGTTACTTTTTTTTTGCTTTATAATATGAATCTCACACACTGCTTTGTTATGCCTAATGAATCTTCACATTGGCTTTCAG
AACTTAAATTTGAGATCTTTATTGTTTATGTTTTTTGCTTTATATGGTAAAGTAATTCCTCAATTCTTGTGCCATACAGAAAAATAATGAAATCTGAAAGTTATAA
ACAGCCCTTTTCTAAATAGCCTGGTGGACACATCTTGCATTCCTCAATTCTTGTGCCATACAGAAAAATAATGAAATCTGAAAGTTATAA
GTCATTGGAAGTTCTTTATTGCATTGAAAGTTCTTTTATTAATTTTCTTTATTAAACTTTGATGGAACCAATCACATTTGATGTGGAACCAAGTTGATTTTGATG
CTTTAGCTTCATTGCATTGAAAGTTCTTTTATTAATTAACTTTTGACTAAACTCACATTTTGAAAAAAAATCACATTTGATGTGGAACCAAGTTGATTTTGATG
GTGAAAGTTATAACTATTAACTTTTGACTAAACTCACCATCAAACTCAAAATCATGGACACATTGAGAAGGATGAATCCTGGGTTCCA (SEQ ID NO:1)
GATTTTGCAGGAGAATTAGCCACAGAACTCACCATCAAACTCAAAATCATGGACACATTGAGAAGGATGAATCCTGGGTTCCA (SEQ ID NO:1)

FAD3A_T03
ATGGTTAAAGACACAAAGCCTTTAGCCTATGCTGCTAATAATGGATACCAAAAGGAAGCTTTTGATCCTCCTCCACCGTTTAAGATTGCA
GAAATCAGAGTTGCAATACAGTTGCTGGGTCAAGAATCCATGGAGATCCCTCAGTTATGTTCTCAGGGATGTGCTTGTAATTGCTGCATTG
ATGGCTGCTGCAAGTCACTTCAACAACTGCTTCTCTGGCTAATCTATTGGCCCATTCAAGGAACAATGTTCTGGGCTCTGTTTGTTCTTGGACAT
GATTGGTAATTAATTTGTTGTTACTTTTTTTTTGCTTTATAATATGAATCTCACACACTGCTTTGTTATGCCTAATGAATCTTCACATTGGCTTTAGAC
AACTTAAATTTGAGATCTTTATTGTTTATGTTTTTTGCTTTATATGGTAAAGTAATTCCTCAATTCTTGTGCCATACAGAAAAATAATGAAATCTGAAAGTTATAAG
ACAGCCCTTTTCTAAATAGCCTGGTGGACACATCTTGCATTCCTCAATTCTTGTGCCATACAGAAAAATAATGAAATCTGAAAGTTATAA
GTCATTGGAAGTTCTTTATTGCATTGAAAGTTCTTTTATTAATTAACTTTTGACTAAACTCACATTTTGAAAAAAAATCACATTTGATGTGGAACCAAGTTGATTTTGATG
CTTTAGCTTCATTGCATTGAAAGTTCTTTTATTAATTAACTTTTGACTAAACTCACATTTTGAAAAAAAATCACATTTGATGTGGAACCAAGTTGATTTTGATG
GTGAAAGTTATAACTATTAACTTTTGACTAAACTCACCATCAAACTCAAAATCATGGACACATTGAGAAGGATGAATCCTGGGTTCCA (SEQ ID NO:1)
GATTTTGCAGGAGAATTAGCCACAGAACTCACCATCAAACTCAAAATCATGGACACATTGAGAAGGATGAATCCTGGGTTCCA (SEQ ID NO:1)

FIG. 2

FAD3B_T01
ATGGTTAAAGACACCAAAGCCTTTAGCCTATGCTGCCAATAATGGATACCAACAAAAGGGTTCTTCTTTTGATTTTGATCCTAGCGCTCCTCCACCG
TTTAAGATTGCAGAGATCAGAGCTTCAATACCAAAACATTGCTGGGTCAAGAATCCCTCAGTTATGTTCTCAGGGATGTGCTTGTA
ATTGCTGCATTGGTGGCTGCAGCAATTCACTTCGACAACTGGCTTCTCTTTTTTTTTATTGCCCATTCTATTGCCCTAATCTATTGCCCTAATCTATTGCCCTCTCTTT
GTTCTTGGACATGATTGGTAATGGCTTTAGACAACTTAAATTTGTGTTTCTTACTCTTTTTATTATGTTTTTGCTTATATGTAAAGTCACACATTGTTCTGTTATGTC
ATTTCTTCTTCATTTGAATTGAACAGTGCCATGGCCATACTGGTTAGTTCATATCGCCTTTTTTGTTTCATTTGTTGATTGTCATTGATAACATCTTGATTCTTGCATTCTTGCATTCCTCAATTCTTATTCTTCA
TTGATTGAATTGAACAGTGCCATGGCCATACTGGTTAGTTCATATCGCCTTTTTTGTTTCATTGTTCATTGAATAGCCGTGGACACATCTTGTTGATTCAATTATTTTATAGTGTGTTG
GAAGCCCGTTTGAGAAAATAAGAAATCGCATCGGAAATAAGAAACCCATTGGAACCCAATTTATTGATAAATGACACAATTTAGCTTCATCGTCGTTGCAAGTTATAACGTTAGCTTCTGAGTAAACGTGGAAAAA
CCACATTTTGGAATTTGGAACCCAATTTATTGATAAATGACACAATTTAGCTTCATCGTCGTTGCAAGTTATAACGTTAGCTTCTGAGTAAACGTGGAAAAA
CAAAACCATGGACACCATTGAGAAGGATGAGTCATGGGTTCCA (SEQ ID NO:2)

FAD3B_T02
ATGGTTAAAGACACCAAAGCCTTTAGCCTATGCTGCCAATAATGGATACCAACAAAAGGGTTCTTCTTTTGATTTTGATCCTAGCGCTCCTCCACCG
TTTAAGATTGCAGAGATCAGAGCTTCAATACCAAAACATTGCTGGGTCAAGAATCCCTCAGTTATGTTCTCAGGGATGTGCTTGTA
ATTGCTGCATTGGTGGCTGCAGCAATTCACTTCGACAACTGGCTTCTCTTTTTTATTGCCCTAATCTATTGCCCTCTCTTT
GTTCTTGGACATGATTGGTAATGGCTTTAGACAACTTAAATTTGTGTTTCTTACTCTTTTATTATGTTTTTGCTTATATGTAAAGTCACACATTGTTCTGTTATGTC
ATTTCTTCTTCATTTGAATTGAACAGTGCCATGGCCATACTGGTTAGTTCATATCGCCTTTTTTGTTTCATTGTTGATTGTCATTGATAGCCGTGGACACATCTTGTTGATTCAATTATTTTATAGTGTGTTG
TTGATTGAATTGAACAGTGCCATGGCCATACTGGTTAGTTCATATCGCCTTTTTTGTTTCATTGTTGATTGTCATTGATAGCCGTGGACAAAAAAATCTTTTGTTGATTCGTCGTTGCAAGTTCTTTTATTGGTTAAAT
GAAGCCCGTTTGAGAAAATAAGAAATCGCATCGGAAATAAGAAACCCATTTGGAACCCAATTTATTGATAAATGACAACCAAATTGATTTTGATGGATTTTGAGAAGAATTAGCCACAGAACTCACCAT
CCACATTTTGGAATTTGGAACCCAATTTATTGATAAATGACAACCAAATTGATTTTGATGGATTTTGAGAAGAATTAGCCACAGAACTCACCAT
CAAAACCATGGACACCATTGAGAAGGATGAGTCATGGGTTCCA (SEQ ID NO:2)

FAD3B_T03
ATGGTTAAAGACACCAAAGCCTTTAGCCTATGCTGCCAATAATGGATACCAACAAAAGGGTTCTTCTTTTGATTTTGATCCTAGCGCTCCTCCACCG
TTTAAGATTGCAGAGATCAGAGCTTCAATACCAAAACATTGCTGGGTCAAGAATCCCTCAGTTATGTTCTCAGGGATGTGCTTGTA
ATTGCTGCATTGGTGGCTGCAGCAATTCACTTCGACAACTGGCTTCTCTTTTTTATTGCCCTAATCTATTGCCCTCTCTTT
GTTCTTGGACATGATTGGTAATGGCTTTAGACAACTTAAATTTGTGTTTCTTACTCTTTTATTATGTTTTTGCTTATATGTAAAGTCACACATTGTTCTGTTATGTC
ATTTCTTCTTCATTTGAATTGAACAGTGCCATGGCCATACTGGTTAGTTCATATCGCCTTTTTTGTTTCATTGTTGATTGTCATTGATAGCCGTGGACACATCTTGTTGATTCAATTATTTTATAGTGTGTTG
TTGATTGAATTGAACAGTGCCATGGCCATACTGGTTAGTTCATATCGCCTTTTTTGTTTCATTGTTGATTGTCATTGATAGCCGTGGACAAAAAAATCTTTTGTTGATTCGTCGTTGCAAGTTCTTTTATTGGTTAAAT
GAAGCCCGTTTGAGAAAATAAGAAATCGCATCGGAAATAAGAAACCCATTTGGAACCCAATTTATTGATAAATGACAACCAAATTGATTTTGATGGATTTTGAGAAGAATTAGCCACAGAACTCACCAT
CCACATTTTGGAATTTGGAACCCAATTTATTGATAAATGACAACCAAATTGATTTTGATGGATTTTGAGAAGAATTAGCCACAGAACTCACCAT
CAAAACCATGGACACCATTGAGAAGGATGAGTCATGGGTTCCA (SEQ ID NO:2)

FIG. 3

FAD3C_T01
ATGGTTCAAGCACACAGCCTCTACAACATGTTGGTAATGGTGCAGGGAAAGAAGATCAAGCTTATTTTGATCCAAGTGCTCCACCACCCTTCAAGATTG
CAAATATCAGAGCAGCAGCAATTCCAAAACATTGAGATCTCTGAGTTATGTTCTGGCCTGCACAAGGCACAATGTTTTGGGCACTTTTGTTCTTGGACAT
GGTAGCTGCAGCAATCGGCTTCAATAGCTGGTTCTTCTGGCCACTCTATTGCCTGCACAAGGCACAATGTTTTGGGCACTTTTGTTCTTGGACAT
GATTGGTAACTAATTATTATTACAAATTGTTCGTTCATATGTTCTCGTCACTCTTGCACTCTTGTTAAATTTGATTGATGCATGGAACAGTGGTCATGGATGGTCCTTTTAGCAACTTTTCATGTTCACTTTG
GTTATGCATGATGATTGTTCGTTCATATGTTCTCGTCACTCTTGCACTCTTGCACTCTTGTTAAATTTGATTGATGCATGGAACAGTGGTCATGGATGGTCCTTTTAGCAACTTTTCATGTTCACTTTG
TGTTGAACAGCATTGTGGGCCACATCTTGTTAAAAATCTTGGTCTGATTTAACAACCATTTTACAACTCATGATTTTTTGCAGGAGAATTAGC
TCCTTAAATTTTTTATGTTGTTAAAAATCTTGGTCTGATTGTGTCTGATTTAACAACCATTTTACAACTCATGATTTTTTGCAGGAGAATTAGC
CACAGGACTCACCATCAGAACCATGGCCATGTTGAGAAGGATGAATCATGGGTTCCG (SEQ ID NO:3)

FAD3C_T02
ATGGTTCAAGCACACAGCCTCTACAACATGTTGGTAATGGTGCAGGGAAAGAAGATCAAGCTTATTTTGATCCAAGTGCTCCACCACCCTTCAAGATTG
CAAATATCAGAGCAGCAGCAATTCCAAAACATTGAGATCTCTGAGTTATGTTCTGAGTTATGTTCTGAGTTGTTTGGGCACTTTTGTTCTTGGACAT
GGTAGCTGCAGCAATCGGCTTCAATAGCTGGTTCTTCTGGCCACTCTATTGCCTGCACAAGGCACAATGTTTTGGGCACTTTTGTTCTTGGACAT
GATTGGTAACTAATTATTATTACAAATTGTTCGTTCATATGTTCTCGTCACTCTTGCACTCTTGTTAAATTTGATTGATGCATGGAACAGTGGTCATGGATGGTCCTTTTAGCAACTTTTCATGTTCACTTTG
GTTATGCATGATGATTGTTCGTTCGTCGTCACTCTTGCACTCTTGCACTCTTGTTAAATTTGATTGATGCATGGAACAGTGGTCATGGATGGTCCTTTTAGCAACTTTTCATGTTCACTTTG
TGTTGAACAGCATTGTGGGCCACATCTTGTTAAAAATCTTGGTCTGATTGTGTCTGATTTAACAACCATTTTACAACTCATGATTTTTTGCAGGAGAATTAGC
TCCTTAAATTTTTTATGTTGTTAAAAATCTTGGTCTGATTGTGTCTGATTTAACAACCATTTTACAACTCATGATTTTTTGCAGGAGAATTAGC
CACAGGACTCACCATCAGAACCATGGCCATGTTGAGAAGGATGAATCATGGGTTCCG (SEQ ID NO:3)

FAD3C_T03
ATGGTTCAAGCACACAGCCTCTACAACATGTTGGTAATGGTGCAGGGAAAGAAGATCAAGCTTATTTTGATCCAAGTGCTCCACCACCCTTCAAGATTG
CAAATATCAGAGCAGCAGCAATTCCAAAACATTGAGATCTCTGAGTTATGTTCTGGCCTGCACAAGGCACAATGTTTTGGGCACTTTTGTTCTTGGACAT
GGTAGCTGCAGCAATCGGCTTCAATAGCTGGTTCTTCTGGCCACTCTATTGCCTGCACAAGGCACAATGTTTTGGGCACTTTTGTTCTTGGACAT
GATTGGTAACTAATTATTATTACAAATTGTTCGTTCATATGTTCTCGTCACTCTTGCACTCTTGTTAAATTTGATTGATGCATGGAACAGTGGTCATGGATGGTCCTTTTAGCAACTTTTCATGTTCACTTTG
GTTATGCATGATGATTGTTCGTTCATATGTTCTCGTCACTCTTGCACTCTTGCACTCTTGTTAAATTTGATTGATGCATGGAACAGTGGTCATGGATGGTCCTTTTAGCAACTTTTCATGTTCACTTTG
TGTTGAACAGCATTGTGGGCCACATCTTGTTAAAAATCTTGGTCTGATTGTGTCTGATTTAACAACCATTTTACAACTCATGATTTTTTGCAGGAGAATTAGC
TCCTTAAATTTTTTATGTTGTTAAAAATCTTGGTCTGATTGTGTCTGATTTAACAACCATTTTACAACTCATGATTTTTTGCAGGAGAATTAGC
CACAGGACTCACCATCAGAACCATGGCCATGTTGAGAAGGATGAATCATGGGTTCCG (SEQ ID NO:3)

FIG. 4

FAD2-1A
ATGGTCATGATTGATTTCACTCTCTCTAATCTCTCCATTCATTTTGTAGTTGTCATTATCTTTAGATTTTTCACTTACCTGGTTTAAAATTGAGGGATTGTA
GTTCTGTTGGTACATATTACACATTCAGCAAAACAACTGAAACTCAACTTGTTTATACTTTGACACAGGGTCTAGCAAAGGAAACAACAATG
GGAGGTAGAGGTCGTGTGGCCAAAGTTCAAGGAAGTTCAAGGAAGAAGCCTCTCATTCTCCACTTCATTGTTTTATGACCTTCATTTCTACATTGC
AGAAAGCAATTCCACCACACTGCTTTCAGCGCTCCCCCTTTTCCCTCCTATGTCTATTGGTTCTCCAAGGTTGCCTTCTCACTGGTGTGGGTG
CACCACCTACTTCCACCTCCTCCCAATGCCTTCAGCAAGTACCAATGGGTTGATGATGTTGTGGGTTTGACCCTTGTCCCTTATT
ATTGCTCACGAGTGTGGTCACATCGCcgcCATCACTCCAACACAGGTTCCCTTGCCGTCAACACTCACAATAGGGTGGCCTATGTATTTAGCCTTCAATGTCTCT
TCTCATGGAAAATAAGCCATCGCcgcCATCACTCCAACACAGGTTCCCTTGCCGTCAACACTCACAATAGGGTGGCCTATGTATTTAGCCTTCAATGTCTCT
GTTTTCCAAGTACTTAAACAACCCTCTAGGAAGGCTGTTTCTCTTCTCGTCACACTCACAATAGGGTGGCCTATGTATTTAGCCTTCAATGTCTCT
GGTAGACCCTATGATAGTTTTGCAAGCCACTACCACCCTTATGCTCGCCGTGACACTCTAACCGTGAGAGGCTTCTGATCTATGTCTCTGATGTTGCTTT
TGTTTCTGTGACTTACTCTCTCTACCGTGTTGCAACCTGAAAGGGTTGGTTGCCTGCTATGTGTTTAGGGGTGCCTTTGCCTTGTGAACGG
TTTCTTGTGACTATCACATATTGCAGCACACAAGGTGTTTCATCACATAACTGATACTCATGTGCCTCACCATCTCTCTCTACAATGCCACATTACCATG
ATGGACAGAGATTATGGGGATTCTGAACAAGCCAATGCAATCAAGCCAATATTGGGTGAGTACTACCACACCATTTTACAAGGCACTGTGGAGAGAAGCGAGAGA
GTGCCTCTATGTGAGCCAGATGAAGGAACATCCGAGAAGGGCGTGTATTGGTACAGGAACAAGTATTGA (SEQ ID NO: 4)

FIG. 5

FAD2-1B

ATGGGTCATGATTTCACTCTCTCTAATCTGTCACTTCCCTCTCCATTCATTTTGTACTTCTCATATTTTCACTTCCTGGTTGAAAATTGTAGTTCTCT
TGGTACATACTAGTATTAGACATTCAGCAACAACTGAACAACTGAACTTCTTTATACTTTGACACAGGGTCTAGCAAAGGAAACAATAATGGGAGG
TGGAGGCCGTGTGGCCAAAGTTGAAATTCAGCAGAAGAAGCCTCTCATTGTCCTATGTTGTTTATGACCTTCCAAGGTTGCATTCTTACATTGCCAC
AGCCATTCCACCGCACTGCTTTCAGCGTTCCCCTCACCCCTTTTCCCTCACCTCATTGCATGGGTTGATGATGTTATGGGTTCACTCAGCACTTTTAGTCCCTTATTT
CACCTACTTCCACCTCCCTCACCCCTTTTCCCTCACCTCATTGCATGGGTTGATGATGTTATGGGTTCACTCAGCACTTTTAGTCCCTTATTT
TGCTCACGAGTGTGGTCACCATGCCTTCAGCAAGTACCCATGGGTTCCCTGCTTCTCTTCTCATCACACTCACAATATTCAAATCGTGAGAGGCTTTTGATCTATGTCTC
CTCATGGAAAATAAGCCATCGccgcCACCACTCCAAACACGGGTCGTCTTCTCTTCTCATCACACTCACAATAGGGTGGCCTTTGTATTTAGCCTTCAATGTCTC
GTACACCAAGTACCTGAACAACCCTCTAGGAAGGCTGCTTCTCTTCTCATCACACTCACAATAGGGTGGCCTTTGTATTTAGCCTTCAATGTCTC
TGGCAGACCCTATGATGGTTTTGCTACTTGCTCTACCGTGTTGCAACTATGAAAAGGGTTGGTTTTGGCTGCTATGTGTTCCATTGCCATTGTCATTGTGAA
TTTGTTTTCTGTGACTTACTTGCTCTACCGTGTTGCAACTATGAAAAGGGTTGGTTTTGGCTGCTATGTGTTCCATTGCCATTGTCATTGTGAA
CGGTTTTCTTGTGACAGATTATGAGAATTCTGAACAAGGTGTTTCACCACATAACTGATACTCATGTGCCTCACCATCTTTTCTCTACAATGCCACATTA
CCATGCAAACGGAGGCAACCAATGCAATGAAGCCAATATTGGGTGAGTACCATTTGATGACACCACCATTTTACAAGGCACTGTGGAGAGAAGC
AAGAGAGTGCCTATGTGGAGCCAGATGAAGAACATCCGAGAAGGGCGTGTATTGGTACAGGAACAAGTATTGA (SEQ ID NO: 5)

FIG. 7

FAD3A

| Sequence | Number of Deletions | SEQ ID NO: |
|---|---|---|
| CTAAATAGCCTGGTGGGACACATCTTGCATTCCTCAATTCTTGTGCC | 0 | 45 |
| CTAAATAGCCTGGTGGGAC-------GCATTCCTCAATTCTTGTGCC | 7 | 46 |
| CTAAATAGCCTGGTGGGACACTT-------TCCTCAATTCTTGTGCC | 7 | 47 |
| CTAAATAGCCTGGTGGGAGCATT--------CCTCAATTCTTGTGCC | 8 | 48 |
| CTAAATAGCCTGGTGGGACACA----GCATTCCTCAATTCTTGTGCC | 4 | 49 |
| CTAAATAGCCTGGTGGGA-------TGCATTCCTCAATTCTTGTGCC | 7 | 50 |
| CTAAATAGCCTGGTGGGACAG------CATTCCTCAATTCTTGTGCC | 6 | 51 |
| CTAAATAGCCTGGTGGGCA---------CTTCCCTCAATTCTTGTGCC | 9 | 52 |

FAD3B

| Sequence | Number of Deletions | SEQ ID NO: |
|---|---|---|
| CTGAAATAGCCTGGTGGGACACATCTTGCATTCCTCAATTCTTGTGCC | 0 | 53 |
| CTGAAATAGCCTGGTGGGACACA-----TGCATTCCTCAATTCTTGTGCC | 5 | 54 |
| CTGAAATAGCCTGGTGGGACACAT---GCATTCCTCAATTCTTGTGCC | 3 | 55 |
| CTGAAATAGCCTGGTGGGACACAT-------TCCTCAATTCTTGTGCC | 7 | 56 |
| CTGAAATAGCCTGGTGGGACA------GCATTCCTCAATTCTTGTGCC | 6 | 57 |
| CTGAAATAGCCTGGTGGGACA---------TTCCTCAATTCTTGTGCC | 9 | 58 |
| CTGAAATAGCCTGGTGGGACAC-----GCATTCCTCAATTCTTGTGCC | 5 | 59 |
| CTGAAATAGCCTGGTGGGACA------GCATTCCTCAATTCTTGTGCC | 6 | 60 |

FIG. 8

FAD2-1A

| Sequence | Number of Deletions | SEQ ID NO: |
|---|---|---|
| AACACTTTTTAGTCCCTTATTTCTCATGGAAAATAAGCCATCGCCGCCATCACTCCAACACAGGTTCCCTTGACCGTGATGAAGTGTTTGTCCC | 0 | 61 |
| AACA---------------------------------------------------------------CTTGACCGTGATGAAGTGTTTGTCCC | -63 | 62 |

FAD2-1B

| Sequence | Number of Deletions | SEQ ID NO: |
|---|---|---|
| AGCACTTTTTAGTCCCTTATTTCTCATGGAAAATAAGCCATCGCCGCCACCACTCCAACACGGGTTCCCTTGACCGTGATGAAGTGTTTGTCCC | 0 | 63 |
| AGCACTTTTTAGTCCCTTATTTCTCATGGAAAATAAGCCATCGCC-----------------------CTTGACCGTGATGAAGTGTTTGTCCC | -23 | 108 |

FIG. 10

| Gene | Target Sequence Left | SEQ ID NO: | Target Sequence Right | SEQ ID NO: |
|---|---|---|---|---|
| FAD2_T01_C11 | GCCACCACCTACTTCCACCTCCT | 4902 | ATTGCATGGCCAATCT | 4903 |
| FAD2_T01_C40 | GCCACCACCTACTTCCACCTCCT | 4902 | ATTGCATGGCCAATCT | 4903 |
| FAD2_T02_C11 | ACATTGCCACCACCTACTTCCACCT | 4904 | ATTGCATGGCCAATCT | 4903 |
| FAD2_T02_C40 | ACATTGCCACCACCTACTTCCACCT | 4904 | ATTGCATGGCCAATCT | 4903 |
| FAD2_T03_C11 | CTCATGGAAAATAAGCCAT | 4905 | ACCGTGATGAAGTGTTTGTCCC | 4906 |
| FAD2_T03_C40 | CTCATGGAAAATAAGCCAT | 4905 | ACCGTGATGAAGTGTTTGTCCC | 4906 |
| FAD2_T04_C11 | ATTTCTCATGGAAAATAAGCCAT | 4907 | ACCGTGATGAAGTGTTTGTCCC | 4906 |
| FAD2_T04_C40 | ATTTCTCATGGAAAATAAGCCAT | 4907 | ACCGTGATGAAGTGTTTGTCCC | 4906 |

FIG. 11

| | Argentina | | South Dakota | | | |
|---|---|---|---|---|---|---|
| | fad2-1a fad2-1b | WT | fad2-1a fad2-1b (Lot 1) | fad2-1a fad2-1b (Lot 2) | WT (Lot 1) | WT (Lot 2) |
| Moisture by Forced Draft Oven - (%) | 5.41 | 5.47 | 5.96 | 5.96 | 6.12 | 6.18 |
| Protein, Combustion - (%) | 37.93 | 34.49 | 40.8 | 39.11 | 38.4 | 37.6 |
| Crude Fat - (%) | 18.8 | 18.36 | 15.56 | 15.7 | 15.78 | 15.6 |
| Tryptophan - (%) | 0.53 | 0.53 | 0.57 | 0.57 | 0.54 | 0.55 |
| Cystine - (%) | 0.55 | 0.53 | 0.58 | 0.58 | 0.53 | 0.56 |
| Methionine - (%) | 0.54 | 0.52 | 0.57 | 0.57 | 0.54 | 0.56 |
| Alanine - (%) | 1.64 | 1.58 | 1.63 | 1.63 | 1.61 | 1.61 |
| Arginine - (%) | 2.76 | 2.53 | 2.87 | 2.82 | 2.73 | 2.75 |
| Aspartic Acid - (%) | 4.28 | 4.23 | 4.41 | 4.38 | 4.33 | 4.31 |
| Glutamic Acid - (%) | 6.77 | 6.55 | 6.88 | 6.9 | 6.79 | 6.83 |
| Glycine - (%) | 1.64 | 1.58 | 1.63 | 1.63 | 1.61 | 1.62 |
| Histidine - (%) | 1 | 0.97 | 1.02 | 1.03 | 1.01 | 1.01 |
| Isoleucine - (%) | 1.78 | 1.68 | 1.71 | 1.73 | 1.73 | 1.7 |
| Leucine - (%) | 2.86 | 2.78 | 2.84 | 2.86 | 2.83 | 2.82 |
| Phenylalanine - (%) | 1.89 | 1.81 | 1.9 | 1.91 | 1.89 | 1.87 |
| Proline - (%) | 1.93 | 1.82 | 1.93 | 1.93 | 1.84 | 1.93 |
| Serine - (%) | 1.92 | 1.9 | 1.97 | 1.95 | 1.91 | 1.92 |
| Threonine - (%) | 1.48 | 1.47 | 1.52 | 1.51 | 1.49 | 1.49 |
| Total Lysine - (%) | 2.46 | 2.34 | 2.44 | 2.49 | 2.46 | 2.43 |
| Tyrosine - (%) | 1.31 | 1.27 | 1.3 | 1.31 | 1.28 | 1.27 |
| Valine - (%) | 1.85 | 1.74 | 1.79 | 1.82 | 1.8 | 1.74 |
| Palmitic Acid - (%) | 7.52 | 11.9 | 7.64 | 7.54 | 11.08 | 11.9 |
| Stearic Acid - (%) | 4.01 | 4.55 | 3.19 | 3.2 | 3.89 | 4.55 |
| Oleic Acid - (%) | 79.05 | 20.71 | 75.7 | 76.66 | 21.97 | 20.71 |
| Linoleic Acid - (%) | 1.89 | 51.68 | 4.58 | 3.84 | 50.87 | 51.68 |
| Alpha Linolenic Acid - (%) | 3.68 | 7.97 | 5.51 | 5.43 | 9.14 | 7.97 |
| Total Fatty Acids - (%) | 17.95 | 17.82 | 15.06 | 15.64 | 15.43 | 17.82 |

FIG. 12

| Row | Plant ID NO (CLXT_LL6) | FAD3A genotype | Myristic Acid C14:0 | Palmitic Acid C16:0 | Stearic Acid C18:0 | Oleic Acid C18:1 | Linoleic Acid C18:2 | Linolenic Acid C18:3 | Arachidate Acid C20:0 | Eicosenoic Acid C20:1 | Behenic Acid C22:0 | Erucic Acid C22:1 | Lignoceric Acid C24:0 |
|---|---|---|---|---|---|---|---|---|---|---|---|---|---|
| 1 | 080 | 43bp/4bp | 0.1% | 7.6% | 3.2% | 79.3% | 4.7% | 4.0% | 0.3% | 0.3% | 0.4% | 0.0% | 0.1% |
| 2 | 079 | 43bp/43bp | 0.1% | 7.3% | 3.4% | 79.6% | 4.6% | 3.9% | 0.4% | 0.3% | 0.4% | 0.0% | 0.1% |
| 3 | 072 | 43bp/4bp | 0.1% | 7.4% | 3.3% | 79.5% | 4.8% | 3.8% | 0.4% | 0.3% | 0.4% | 0.0% | 0.1% |
| 4 | 073 | 4bp/4bp | 0.1% | 7.7% | 3.4% | 79.4% | 4.5% | 4.0% | 0.3% | 0.3% | 0.4% | 0.0% | 0.1% |
| 5 | 076 | 43bp/43bp | 0.1% | 7.7% | 3.4% | 77.9% | 5.5% | 4.3% | 0.3% | 0.3% | 0.3% | 0.0% | 0.1% |
| 6 | 074 | 4bp/4bp | 0.1% | 7.9% | 3.2% | 79.3% | 4.6% | 4.0% | 0.3% | 0.3% | 0.4% | 0.0% | 0.1% |
| 7 | 078 | 43bp/43bp | 0.1% | 8.0% | 3.2% | 77.8% | 5.5% | 4.3% | 0.3% | 0.3% | 0.4% | 0.0% | 0.1% |
| 8 | 080 | 43bp/4bp | 0.1% | 7.5% | 3.3% | 79.2% | 4.9% | 3.8% | 0.4% | 0.3% | 0.4% | 0.0% | 0.1% |
| 9 | 075 | 43bp/43bp | 0.0% | 7.1% | 3.4% | 80.7% | 4.1% | 3.6% | 0.4% | 0.3% | 0.4% | 0.0% | 0.1% |
| 10 | 077 | 43bp/4bp | 0.1% | 7.1% | 3.4% | 80.9% | 3.9% | 3.5% | 0.4% | 0.4% | 0.4% | 0.0% | 0.1% |
| 11 | 075 | 43bp/43bp | 0.1% | 7.4% | 3.3% | 78.8% | 5.4% | 3.9% | 0.3% | 0.3% | 0.4% | 0.0% | 0.1% |
| 12 | 074 | 4bp/4bp | 0.1% | 7.3% | 3.4% | 80.1% | 4.3% | 3.7% | 0.4% | 0.3% | 0.4% | 0.0% | 0.1% |
| 13 | 078 | 43bp/43bp | 0.1% | 7.2% | 3.5% | 80.1% | 4.2% | 3.8% | 0.4% | 0.4% | 0.4% | 0.0% | 0.1% |
| 14 | 076 | 43bp/43bp | 0.1% | 7.4% | 3.4% | 79.6% | 4.5% | 3.9% | 0.4% | 0.3% | 0.4% | 0.0% | 0.1% |
| 15 | 077 | 43bp/4bp | 0.1% | 7.3% | 3.3% | 79.2% | 4.8% | 4.1% | 0.4% | 0.3% | 0.4% | 0.0% | 0.1% |
| 16 | 079 | 43bp/43bp | 0.1% | 7.6% | 3.3% | 79.5% | 4.5% | 3.9% | 0.3% | 0.3% | 0.4% | 0.0% | 0.1% |
| 17 | 073 | 4bp/4bp | 0.1% | 7.4% | 3.4% | 79.1% | 4.7% | 4.1% | 0.4% | 0.3% | 0.4% | 0.0% | 0.1% |

MODIFYING SOYBEAN OIL COMPOSITION THROUGH TARGETED KNOCKOUT OF THE FAD3A/B/C GENES

CROSS-REFERENCE TO RELATED APPLICATIONS

This application is a continuation of International Application No. PCT/IB2017/050574, filed Feb. 2, 2017, which claims benefit of priority from U.S. Provisional Application No. 62/398,246, filed Sep. 22, 2016 and U.S. Provisional Application No. 62/290,154, filed Feb. 2, 2016.

TECHNICAL FIELD

This document relates to materials and methods for making soybean plants that can be used to produce oil having a modified composition as compared to wild type plants. This document also relates to soybean varieties that lack FAD3A/B/C activity.

BACKGROUND

Soybean (*Glycine max*) is an important legume crop worldwide due to its ability to fix atmospheric nitrogen. Soybean also serves as a major source of animal feed protein, and its oil has uses ranging from cooking/frying to the production of biodiesel. Typically, a hydrogenation process is used to increase heat stability and improve the shelf life and taste of soybean oil. However, hydrogenation increases the cost of production and results in the formation of trans fatty acids, which have been linked to cardiovascular disease in humans.

SUMMARY

Provided herein are materials and methods for modifying soybean oil composition by reducing or eliminating expression of the delta-fifteen fatty acid desaturase 3 (FAD3) A, B and C genes without the use of transgenesis. Soybean varieties having such modified oil composition also are provided.

The methods described herein utilize sequence-specific, rare-cutting endonucleases to introduce mutations in the FAD3A, FAD3B and/or FAD3C coding sequences, thereby knocking out gene function. In some cases, the methods described herein also include utilizing sequence-specific, rare-cutting endonucleases to introduce mutations into the FAD2-1A and/or FAD2-1B coding sequences to knock out their gene function. These methods can mediate FAD3A/B/C silencing (with or without FAD2-1A/1B silencing) without insertion of a transgene. Plants containing transgenes are highly regulated in certain jurisdictions, including Europe, and the costs to obtain regulatory approval can be very high. The methods described herein can expedite the production of new varieties, and can be more cost-effective than transgenic or traditional breeding approaches.

In one aspect, this document features a soybean plant, plant part, or plant cell containing a mutation in one or more FAD3A alleles, one or more FAD3B alleles, one or more FAD3C alleles, one or more FAD3A alleles and one or more FAD3B alleles, one or more FAD3A alleles and one or more FAD3C alleles, one or more FAD3B alleles and one or more FAD3C alleles, or one or more FAD3A alleles, one or more FAD3B alleles, and one or more FAD3C alleles, wherein the plant, plant part, or plant cell produces oil that has decreased linolenic acid content and as compared to oil produced from a corresponding wild type soybean plant, plant part, or plant cell. Each mutation can be at a sequence in SEQ ID NO:24, SEQ ID NO:25, or SEQ ID NO:26. The one or more FAD3A alleles can include a mutation selected from the group consisting of (i) a deletion of the adenine nucleotide at position 459 of SEQ ID NO:24, (ii) a deletion of the cytosine nucleotide at position 515 of SEQ ID NO:24, and (iii) a deletion of the adenine nucleotide at position 894 of SEQ ID NO:24. The one or more FAD3B alleles can include a mutation selected from the group consisting of (i) a deletion of the adenine nucleotide at position 496 of SEQ ID NO:25, (ii) a deletion of the cytosine nucleotide at position 552 of SEQ ID NO:25, and (iii) a deletion of the adenine nucleotide at position 952 of SEQ ID NO:25. The one or more FAD3C alleles can have a deletion of the adenine nucleotide at position 686 of SEQ ID NO:26. Each mutation can have been induced by a rare-cutting endonuclease (e.g., a transcription activator-like (TAL) effector endonuclease). The TAL effector endonuclease can bind to a sequence as set forth in any of SEQ ID NOS:6-23. Each mutated FAD3A allele can have a sequence as set forth in any of SEQ ID NOS:64-90 and 102-106, or a sequence with at least 95% identity to any of SEQ ID NOS:64-90 and 102-106. Each mutated FAD3B allele can have a sequence as set forth in any of SEQ ID NOS:91-99, or a sequence with at least 95% identity to any of SEQ ID NOS:91-99. The plant, plant part, or plant cell may not contain a transgene, or the soybean plant, plant part, or plant cell may contain a transgene encoding a protein, where the protein is selected from the group consisting of a plant 5-enolpyruvylshikimate-3-phosphate synthase (EPSPS) protein, a modified plant EPSPS protein, a bacterial EPSPS protein, an *Agrobacterium* CP4 EPSPS protein, an aryloxyalkanoate dioxygenase (AAD) protein, a phosphinothricin N-acetyltransferase (PAT) protein, an acetohydroxyacid synthase large subunit protein, a p-hydroxyphenylpyruvate dioxygenase (hppd) protein, a dicamba monooxygenase (DMO) protein, a Cry1Ac delta-endotoxin protein, Cry1F delta-endotoxin protein, Cry2Ab delta-endotoxin protein, and a Cry1Ac delta-endotoxin protein. The plant part can be a seed. The linolenic acid content can be less than 4.3% (e.g., less than 3%, less than 2%, or less than 1.2%).

In another aspect, this document features oil produced from a soybean seed containing a mutation in one or more FAD3A alleles, one or more FAD3B alleles, one or more FAD3C alleles, one or more FAD3A alleles and one or more FAD3B alleles, one or more FAD3A alleles and one or more FAD3C alleles, one or more FAD3B alleles and one or more FAD3C alleles, or one or more FAD3A alleles, one or more FAD3B alleles, and one or more FAD3C alleles, where the oil has a linolenic acid content less than 4.3%. The oil can have a linolenic acid content less than 1.2%.

In another aspect, this document features a method for making a soybean plant having a mutation in one or more FAD3A alleles, one or more FAD3B alleles, one or more FAD3C alleles, one or more FAD3A alleles and one or more FAD3B alleles, one or more FAD3A alleles and one or more FAD3C alleles, one or more FAD3B alleles and one or more FAD3C alleles, or one or more FAD3A alleles, one or more FAD3B alleles, and one or more FAD3C alleles. The method can include contacting a population of soybean plant parts or plant cells having functional FAD3A, FAD3B, and FAD3C alleles with one or more rare-cutting endonucleases targeted to one or more endogenous FAD3A sequences, one or more rare-cutting endonucleases targeted to one or more endogenous FAD3B sequences, and one or more rare-cutting endonucleases targeted to one or more endogenous FAD3C sequences, regenerating the soybean plant parts or plant cells into whole soybean plants, and selecting from the whole soybean plants a soybean plant having a mutation in one or more FAD3A alleles, one or more FAD3B alleles, one or more FAD3C alleles, one or more FAD3A alleles and one or more FAD3B alleles, one or more FAD3A alleles and one or more FAD3C alleles, one or more FAD3B alleles and one or more FAD3C alleles, or one or more FAD3A alleles, one or more FAD3B alleles, and one or more FAD3C alleles. The soybean plant parts or plant cells can be selected from the group consisting of cotyledon cells, seeds, embryos, embryogenic calli cells, and pollen cells. The method can include transforming the soybean plant parts or plant cells with one or more vectors encoding the one or more rare-cutting endonucleases. The one or more rare-cutting endonucleases can be TAL effector endonucleases. Each of the TAL effector endonucleases can be targeted to a sequence as set forth in any of SEQ ID NOS:6-23. The method can include introducing into the plant parts or plant cells one or more TAL effector endonuclease proteins. The method may include culturing the plant parts or plant cells to generate plant lines. In some cases, the method can further include isolating genomic DNA containing at least a portion of the FAD3A locus, at least a portion of the FAD3B locus, or at least a portion of the FAD3C locus from the plant cells.

In another aspect, this document features a method for generating a soybean plant having a mutation in one or more FAD3A alleles, one or more FAD3B alleles, one or more FAD3C alleles, one or more FAD3A alleles and one or more FAD3B alleles, one or more FAD3A alleles and one or more FAD3C alleles, one or more FAD3B alleles and one or more FAD3C alleles, or one or more FAD3A alleles, one or more FAD3B alleles, and one or more FAD3C alleles. The method can include (a) providing a first soybean plant having a mutation in at least a first FAD3 allele, wherein the first FAD3 allele is selected from the group consisting of a FAD3A allele, a FAD3B allele and a FAD3C allele, (b) providing a second soybean plant having a mutation in at least a second FAD3 gene, wherein the second FAD3 allele is selected from the group consisting of a FAD3A allele, a FAD3B allele and a FAD3C allele, wherein if the first FAD3 allele is a FAD3A allele, the second FAD3 allele is a FAD3B or FAD3C allele, if the first FAD3 allele is a FAD3B allele, the second FAD3 allele is a FAD3A or FAD3C allele, and if the first FAD3 allele is a FAD3C allele, the second FAD3 allele is a FAD3A or FAD3B allele, (c) crossing the first soybean plant with the second soybean plant to generate progeny, and (d) selecting from the progeny a soybean plant that contains a mutation in one or more FAD3A alleles, one or more FAD3B alleles, one or more FAD3C alleles, one or more FAD3A alleles and one or more FAD3B alleles, one or more FAD3A alleles and one or more FAD3C alleles, one or more FAD3B alleles and one or more FAD3C alleles, or one or more FAD3A alleles, one or more FAD3B alleles, and one or more FAD3C alleles. Each mutation can have been induced by a rare-cutting endonuclease (e.g., a TAL effector endonuclease). The TAL effector endonuclease can bind to a sequence as set forth in any of SEQ ID NOS:6-23. Each mutation can be a deletion of more than one nucleotide. The first or second soybean plant can have a FAD3A allele that includes a mutation selected from the group consisting of (i) a deletion of the adenine nucleotide at position 459 of SEQ ID NO:24, (ii) a deletion of the cytosine nucleotide at position 515 of SEQ ID NO:24, and (iii) a deletion of the adenine nucleotide at position 894 of SEQ ID NO:24. The first or second soybean plant can have a FAD3B allele that includes a mutation selected from the group consisting of (i) a deletion of the adenine nucleotide at position 496 of SEQ ID NO:25, (ii) a deletion of the cytosine nucleotide at position 552 of SEQ ID NO:25, and (iii) a deletion of the adenine nucleotide at position 952 of SEQ ID NO:25. The first or second soybean plant can have a FAD3C allele that includes a deletion of the adenine nucleotide at position 686 of SEQ ID NO:26. Each mutated FAD3A allele can have a sequence as set forth in any of SEQ ID NOS:64-90 and 102-106, or a sequence with at least 95% identity to any of SEQ ID NOS:64-90 and 102-106. Each mutated FAD3B allele can have a sequence as set forth in any of SEQ ID NOS:91-99, or has a sequence with at least 95% identity to any of SEQ ID NOS:91-99. The first and second soybean plants may not contain a transgene, or one or both of the first and second soybean plants can contain a transgene that encodes a protein, where the protein is selected from the group consisting of a plant EPSPS protein, a modified plant EPSPS protein, a bacterial EPSPS protein, an *Agrobacterium* CP4 EPSPS protein, an AAD protein, a PAT protein, an acetohydroxyacid synthase large subunit protein, a hppd protein, a DMO protein, a Cry1Ac delta-endotoxin protein, Cry1F delta-endotoxin protein, Cry2Ab delta-endotoxin protein, and a Cry1Ac delta-endotoxin protein.

In still another aspect, this document features a method for producing soybean oil having decreased linolenic acid content. The method can include (a) providing a soybean plant, plant part, or plant cell having a mutation in one or more FAD3A alleles, one or more FAD3B alleles, one or more FAD3C alleles, one or more FAD3A alleles and one or more FAD3B alleles, one or more FAD3A alleles and one or more FAD3C alleles, one or more FAD3B alleles and one or more FAD3C alleles, or one or more FAD3A alleles, one or more FAD3B alleles, and one or more FAD3C alleles; and (b) producing oil from the plant, plant part, or plant cell. Each mutation can have been induced by a rare-cutting endonuclease (e.g., a TAL effector endonuclease). The TAL effector endonuclease can bind to a sequence as set forth in any of SEQ ID NOS:6-23. The one or more FAD3A alleles can include a mutation selected from the group consisting of (i) a deletion of the adenine nucleotide at position 459 of SEQ ID NO:24, (ii) a deletion of the cytosine nucleotide at position 515 of SEQ ID NO:24, and (iii) a deletion of the adenine nucleotide at position 894 of SEQ ID NO:24. The one or more FAD3B alleles can include a mutation selected from the group consisting of (i) a deletion of the adenine nucleotide at position 496 of SEQ ID NO:25, (ii) a deletion of the cytosine nucleotide at position 552 of SEQ ID NO:25, and (iii) a deletion of the adenine nucleotide at position 952 of SEQ ID NO:25. The one or more FAD3C alleles can have a deletion of the adenine nucleotide at position 686 of SEQ ID NO:26. The plant, plant part, or plant cell may not contain a transgene, or may contain a transgene that encodes a protein, wherein the protein is selected from the group consisting of a plant EPSPS protein, a modified plant EPSPS protein, a bacterial EPSPS protein, an *Agrobacterium* CP4 EPSPS protein, an AAD protein, a PAT protein, an acetohydroxyacid synthase large subunit protein, a hppd protein, a DMO protein, a Cry1Ac delta-endotoxin protein, Cry1F delta-endotoxin protein, Cry2Ab delta-endotoxin protein, and a Cry1Ac delta-endotoxin protein. Each mutated FAD3A allele can have a sequence as set forth in any of SEQ ID NOS:64-90 and 102-106, or a sequence with at least 95% identity to any of SEQ ID NOS:64-90 and 102-106. Each mutated FAD3B allele can have a sequence as set forth in any of SEQ ID NOS:91-99, or a sequence with at least 95% identity to any of SEQ ID NOS:91-99.

In another aspect, this document features a soybean plant, plant part, or plant cell having a mutation in a FAD2-1A allele and a mutation in a FAD2-1B allele, wherein the plant, plant part, or plant cell has increased protein content compared to a corresponding wild type soybean plant, plant part, or plant cell, and wherein the plant, plant part, or plant cell produces oil that has increased oleic acid content as compared to oil produced from a corresponding wild type soybean plant, plant part, or plant cell. Each mutated FAD2-1A allele can have a sequence as set forth in SEQ ID NO:100, or a sequence with at least 95% identity to SEQ ID NO:100. Each mutated FAD2-1B allele can have a sequence as set forth in SEQ ID NO:101, or a sequence with at least 95% identity to SEQ ID NO:101. The plant part can be a seed.

In another aspect, this document features oil produced from the seed of a soybean plant having a mutation in a FAD2-1A allele and a mutation in a FAD2-1B allele, wherein the soybean plant has increased protein content compared to a corresponding wild type soybean plant, and wherein the oil has increased oleic acid content as compared to oil produced from a corresponding wild type soybean plant. The oil can have a linolenic acid content less than 4.9%, a linoleic acid content less than 6.4%, an oleic acid content more than 76.5%, a stearic acid content less than 3.5%, and a palmitic acid content less than 8.5%.

In yet another aspect, this document features a soybean plant, plant part, or plant cell having (a) a mutation in one or more FAD3A alleles, one or more FAD3B alleles, one or more FAD3C alleles, one or more FAD3A alleles and one or more FAD3B alleles, one or more FAD3A alleles and one or more FAD3C alleles, one or more FAD3B alleles and one or more FAD3C alleles, or one or more FAD3A alleles, one or more FAD3B alleles, and one or more FAD3C alleles, and (b) a mutation in one or more FAD2-1A alleles, one or more FAD2-1B alleles, or one or more FAD2-1A alleles and one or more FAD2-1B alleles, where the plant, plant part, or plant cell produces oil that has decreased linolenic acid content, increased oleic acid content, and decreased linoleic acid content as compared to oil produced from a corresponding wild type soybean plant, plant part, or plant cell. Each FAD3 mutation can be at a sequence in SEQ ID NO:24, SEQ ID NO:25, or SEQ ID NO:26, and each FAD2 mutation can be at a sequence in SEQ ID NO:43 or SEQ ID NO:44. Each mutation can have been induced by a rare-cutting endonuclease (e.g., a TAL effector endonuclease). The TAL effector endonuclease can bind to a sequence as set forth in any of SEQ ID NOS:6-23, or to a sequence as set forth in any of SEQ ID NOS:27-42. Each mutation can be a deletion of more than one nucleotide. The one or more FAD3A alleles can contain a mutation selected from the group consisting of (i) a deletion of the adenine nucleotide at position 459 of SEQ ID NO:24, (ii) a deletion of the cytosine nucleotide at position 515 of SEQ ID NO:24, and (iii) a deletion of the adenine nucleotide at position 894 of SEQ ID NO:24. The one or more FAD3B alleles can contain a mutation selected from the group consisting of (i) a deletion of the adenine nucleotide at position 496 of SEQ ID NO:25, (ii) a deletion of the cytosine nucleotide at position 552 of SEQ ID NO:25, and (iii) a deletion of the adenine nucleotide at position 952 of SEQ ID NO:25. The one or more FAD3C alleles can have a deletion of the adenine nucleotide at position 686 of SEQ ID NO:26. Each mutated FAD3A allele can have a sequence as set forth in any of SEQ ID NOS:64-90 and 102-106, or a sequence with at least 95% identity to any of SEQ ID NOS:64-90 and 102-106. Each mutated FAD3B allele can have a sequence as set forth in any of SEQ ID NOS:91-99, or a sequence with at least 95% identity to any of SEQ ID NOS:91-99. Each mutated FAD2-1A allele can have a sequence as set forth in SEQ ID NO:100, or a sequence with at least 95% identity to SEQ ID NO:100. Each mutated FAD2-1B allele can have a sequence as set forth in SEQ ID NO:101, or a sequence with at least 95% identity to SEQ ID NO:101. Each mutated FAD3A, FAD3B, FAD3C, FAD2-1A, and FAD2-1B allele can have a deletion of an endogenous nucleic acid sequence and does not include any exogenous nucleic acid. The plant, plant part, or plant cell may not contain a transgene, or may contain a transgene that encodes a protein, wherein the protein is selected from the group consisting of a plant EPSPS protein, a modified plant EPSPS protein, a bacterial EPSPS protein, an *Agrobacterium* CP4 EPSPS protein, an AAD protein, a PAT protein, an acetohydroxyacid synthase large subunit protein, a hppd protein, a DMO protein, a Cry1Ac delta-endotoxin protein, Cry1F delta-endotoxin protein, Cry2Ab delta-endotoxin protein, and a Cry1Ac delta-endotoxin protein. The plant part can be a seed.

In another aspect, this document features oil produced from the seed of a soybean plant, plant part, or plant cell having (a) a mutation in one or more FAD3A alleles, one or more FAD3B alleles, one or more FAD3C alleles, one or more FAD3A alleles and one or more FAD3B alleles, one or more FAD3A alleles and one or more FAD3C alleles, one or more FAD3B alleles and one or more FAD3C alleles, or one or more FAD3A alleles, one or more FAD3B alleles, and one or more FAD3C alleles, and (b) a mutation in one or more FAD2-1A alleles, one or more FAD2-1B alleles, or one or more FAD2-1A alleles and one or more FAD2-1B alleles, where the plant, plant part, or plant cell produces oil that has decreased linolenic acid content, increased oleic acid content, and decreased linoleic acid content as compared to oil produced from a corresponding wild type soybean plant, plant part, or plant cell. The oil can have a linolenic acid content less than 3.2%, a linoleic acid content less than 5.0%, an oleic acid content more than 78.6%, a stearic acid content less than 4.6%, and a palmitic acid content less than 8.6%.

In yet another aspect, this document features a method for making a soybean plant containing a mutation in: one or more FAD2-1A alleles, one or more FAD2-1B alleles, and one or more FAD3A alleles; one or more FAD2-1A alleles, one or more FAD2-1B alleles, and one or more FAD3B alleles; one or more FAD2-1A alleles, one or more FAD2-1B alleles, and one or more FAD3C alleles; one or more FAD2-1A alleles, one or more FAD2-1B alleles, one or more FAD3A alleles, and one or more FAD3B alleles; one or more FAD2-1A alleles, one or more FAD2-1B alleles, one or more FAD3A alleles, and one or more FAD3C alleles; one or more FAD2-1A alleles, one or more FAD2-1B alleles, one or more FAD3B alleles, and one or more FAD3C alleles; or one or more FAD2-1A alleles, one or more FAD2-1B alleles, one or more FAD3A alleles, one or more FAD3B alleles, and one or more FAD3C alleles. The method can include (a) providing soybean plant parts or plant cells, where the plant parts or plant cells contain a mutation in one or more FAD2-1A alleles and one or more FAD2-1B alleles, and where the plant parts or plant cells have at least a functional FAD3A, FAD3B, or FAD3C allele, (b) contacting the plant parts or plant cells with one or more rare-cutting endonucleases targeted to an endogenous FAD3A sequence, one or more rare-cutting endonucleases targeted to an endogenous FAD3B sequence, and one or more rare-cutting endonucleases targeted to an endogenous FAD3C sequence, or a combination thereof, (c) regenerating the plant parts or plant cells into whole soybean plants, and (d) selecting from the whole soybean plants a soybean plant containing a mutation in one or more FAD3A alleles, one or more FAD3B alleles, one or more FAD3C alleles, one or more FAD3A alleles and one or more FAD3B alleles, one or more FAD3A alleles and one or more FAD3C alleles, one or more FAD3B alleles and one or more FAD3C alleles, or one or more FAD3A alleles, one or more FAD3B alleles, and one or more FAD3C alleles. The soybean plant parts or plant cells can be selected from the group consisting of cotyledon cells, seeds, embryos, embryogenic calli cells, and pollen cells. Each FAD2-1A allele can have a sequence as set forth in SEQ ID NO:100, or a sequence with at least 95% identity to SEQ ID NO:100. Each FAD2-1B allele can have a sequence as set forth in SEQ ID NO:101, or a sequence with at least 95% identity to SEQ ID NO:101. The contacting can include transforming the soybean plant cells with one or more vectors encoding the one or more rare-cutting endonucleases. The one or more rare-cutting endonucleases can be TAL effector endonucleases. Each mutated FAD3A allele can include a mutation selected from the group consisting of (i) a deletion of the adenine nucleotide at position 459 of SEQ ID NO:24, (ii) a deletion of the cytosine nucleotide at position 515 of SEQ ID NO:24, and (iii) a deletion of the adenine nucleotide at position 894 of SEQ ID NO:24. Each mutated FAD3B allele can include a mutation selected from the group consisting of (i) a deletion of the adenine nucleotide at position 496 of SEQ ID NO:25, (ii) a deletion of the cytosine nucleotide at position 552 of SEQ ID NO:25, and (iii) a deletion of the adenine nucleotide at position 952 of SEQ ID NO:25. Each mutated FAD3C allele can include a deletion of the adenine nucleotide at position 686 of SEQ ID NO:26. Each mutated FAD3A allele can have a sequence as set forth in any of SEQ ID NOS:64-90 and 102-106, or a sequence with at least 95% identity to any of SEQ ID NOS:64-90 and 102-106. Each mutated FAD3B allele can have a sequence as set forth in any of SEQ ID NOS:91-99, or a sequence with at least 95% identity to any of SEQ ID NOS:91-99. Each of the TAL effector endonucleases can be targeted to a sequence as set forth in any of SEQ ID NOS:6-23. The method can include introducing into the plant cells one or more TAL effector endonuclease proteins, culturing the plant cells to generate plant lines, and/or isolating, from the plant cells, genomic DNA containing at least a portion of the FAD3A locus, at least a portion of the FAD3B locus, or at least a portion of the FAD3C locus.

In another aspect, this document features a method for generating a soybean plant containing a mutation in: one or more FAD2-1A alleles, one or more FAD2-1B alleles, and one or more FAD3A alleles; one or more FAD2-1A alleles, one or more FAD2-1B alleles, and one or more FAD3B alleles; one or more FAD2-1A alleles, one or more FAD2-1B alleles, and one or more FAD3C alleles; one or more FAD2-1A alleles, one or more FAD2-1B alleles, one or more FAD3A alleles, and one or more FAD3B alleles; one or more FAD2-1A alleles, one or more FAD2-1B alleles, one or more FAD3A alleles, and one or more FAD3C alleles; one or more FAD2-1A alleles, one or more FAD2-1B alleles, one or more FAD3B alleles, and one or more FAD3C alleles; or one or more FAD2-1A alleles, one or more FAD2-1B alleles, one or more FAD3A alleles, one or more FAD3B alleles, and one or more FAD3C alleles. The method can include (a) providing a first soybean plant containing a mutation in one or more FAD2-1A alleles and one or more FAD2-1B alleles, (b) providing a second soybean plant containing a mutation in at least one FAD3 allele, wherein the FAD3 allele is selected from the group consisting of a FAD3A allele, a FAD3B allele and a FAD3C allele, (c) crossing the first soybean plant with the second soybean plant to generate progeny, and (d) selecting from the progeny a soybean plant that has a mutation in one or more FAD2-1A alleles, one or more FAD2-1B alleles, and one or more FAD3A alleles; one or more FAD2-1A alleles, one or more FAD2-1B alleles, and one or more FAD3B alleles; one or more FAD2-1A alleles, one or more FAD2-1B alleles, and one or more FAD3C alleles; one or more FAD2-1A alleles, one or more FAD2-1B alleles, one or more FAD3A alleles, and one or more FAD3B alleles; one or more FAD2-1A alleles, one or more FAD2-1B alleles, one or more FAD3A alleles, and one or more FAD3C alleles; one or more FAD2-1A alleles, one or more FAD2-1B alleles, one or more FAD3B alleles, and one or more FAD3C alleles; or one or more FAD2-1A alleles, one or more FAD2-1B alleles, one or more FAD3A alleles, one or more FAD3B alleles, and one or more FAD3C alleles. Each mutation can have been induced by a rare-cutting endonuclease (e.g., a TAL effector endonuclease). The TAL effector endonuclease can bind to a sequence as set forth in any of SEQ ID NOS:6-23. Each mutation can be a deletion of more than one nucleotide. Each of the one or more mutated FAD2-1A alleles can have a sequence as set forth in SEQ ID NO:100, or a sequence with at least 95% identity to SEQ ID NO:100. Each of the one or more mutated FAD2-1B alleles can have a sequence as set forth in SEQ ID NO:101, or a sequence with at least 95% identity to SEQ ID NO:101. The mutated FAD3A alleles can include a mutation selected from the group consisting of (i) a deletion of the adenine nucleotide at position 459 of SEQ ID NO:24, (ii) a deletion of the cytosine nucleotide at position 515 of SEQ ID NO:24, and (iii) a deletion of the adenine nucleotide at position 894 of SEQ ID NO:24. The mutated FAD3B alleles can include a mutation selected from the group consisting of (i) a deletion of the adenine nucleotide at position 496 of SEQ ID NO:25, (ii) a deletion of the cytosine nucleotide at position 552 of SEQ ID NO:25, and (iii) a deletion of the adenine nucleotide at position 952 of SEQ ID NO:25. The mutated FAD3C alleles can include a deletion of the adenine nucleotide at position 686 of SEQ ID NO:26. Each mutated FAD3A allele can have a sequence as set forth in any of SEQ ID NOS: 64-90 and 102-106, or a sequence with at least 95% identity to any of SEQ ID NOS:64-90 and 102-106. Each mutated FAD3B allele can have a sequence as set forth in any of SEQ ID NOS:91-99, or a sequence with at least 95% identity to any of SEQ ID NOS:91-99. The first and second soybean plants may not contain a transgene, or one or both of the first and second soybean plants may contain a transgene that encodes a protein, where the protein is selected from the group consisting of a plant EPSPS protein, a modified plant EPSPS protein, a bacterial EPSPS protein, an *Agrobacterium* CP4 EPSPS protein, an AAD protein, a PAT protein, an acetohydroxyacid synthase large subunit protein, a hppd protein, a DMO protein, a Cry1Ac delta-endotoxin protein, Cry1F delta-endotoxin protein, Cry2Ab delta-endotoxin protein, and a Cry1Ac delta-endotoxin protein.

In yet another aspect, this document features a method for producing soybean oil having increased oleic acid and decreased linolenic acid content. The method can include (a) providing a soybean plant, plant part, or plant cell containing a mutation in one or more FAD2-1A alleles, one or more FAD2-1B alleles, and one or more FAD3A alleles; one or more FAD2-1A alleles, one or more FAD2-1B alleles, and one or more FAD3B alleles; one or more FAD2-1A alleles, one or more FAD2-1B alleles, and one or more FAD3C alleles; one or more FAD2-1A alleles, one or more FAD2-1B alleles, one or more FAD3A alleles, and one or more FAD3B alleles; one or more FAD2-1A alleles, one or more FAD2-1B alleles, one or more FAD3A alleles, and one or more FAD3C alleles; one or more FAD2-1A alleles, one or more FAD2-1B alleles, one or more FAD3B alleles, and one or more FAD3C alleles; or one or more FAD2-1A alleles, one or more FAD2-1B alleles, one or more FAD3A alleles, one or more FAD3B alleles, and one or more FAD3C alleles, and (b) producing oil from the plant, plant part, or plant cell. Each mutation can have been induced by a rare-cutting endonuclease (e.g., a TAL effector endonuclease). The TAL effector endonuclease can bind to a sequence as set forth in any of SEQ ID NOS:6-23. Each mutation can be a deletion of more than one nucleotide. Each of the one or more mutated FAD2-1A alleles can have a sequence as set forth in SEQ ID NO:100, or a sequence with at least 95% identity to SEQ ID NO:100. Each of the one or more mutated FAD2-1B alleles can have a sequence as set forth in SEQ ID NO:101, or a sequence with at least 95% identity to SEQ ID NO:101. The mutated FAD3A alleles can include a mutation selected from the group consisting of (i) a deletion of the adenine nucleotide at position 459 of SEQ ID NO:24, (ii) a deletion of the cytosine nucleotide at position 515 of SEQ ID NO:24, and (iii) a deletion of the adenine nucleotide at position 894 of SEQ ID NO:24. The mutated FAD3B alleles can include a mutation selected from the group consisting of (i) a deletion of the adenine nucleotide at position 496 of SEQ ID NO:25, (ii) a deletion of the cytosine nucleotide at position 552 of SEQ ID NO:25, and (iii) a deletion of the adenine nucleotide at position 952 of SEQ ID NO:25. The mutated FAD3C alleles can include a deletion of the adenine nucleotide at position 686 of SEQ ID NO:26. Each of the mutated FAD3A alleles can have a sequence as set forth in any of SEQ ID NOS:64-90 and 102-106, or a sequence with at least 95% identity to any of SEQ ID NOS:64-90 and 102-106. Each of the mutated FAD3B alleles can have a sequence as set forth in any of SEQ ID NOS:91-99, or a sequence with at least 95% identity to any of SEQ ID NOS:91-99. The first and second soybean plants may not contain a transgene, or the first and/or second soybean plant may contain a transgene that encodes a protein, where the protein is selected from the group consisting of a plant EPSPS protein, a modified plant EPSPS protein, a bacterial EPSPS protein, an *Agrobacterium* CP4 EPSPS protein, an AAD protein, a PAT protein, an acetohydroxyacid synthase large subunit protein, a hppd protein, a DMO protein, a Cry1Ac delta-endotoxin protein, Cry1F delta-endotoxin protein, Cry2Ab delta-endotoxin protein, and a Cry1Ac delta-endotoxin protein.

Unless otherwise defined, all technical and scientific terms used herein have the same meaning as commonly understood by one of ordinary skill in the art to which this invention pertains. Although methods and materials similar or equivalent to those described herein can be used to practice the invention, suitable methods and materials are described below. All publications, patent applications, patents, and other references mentioned herein are incorporated by reference in their entirety. In case of conflict, the present specification, including definitions, will control. In addition, the materials, methods, and examples are illustrative only and not intended to be limiting.

The details of one or more embodiments of the invention are set forth in the accompanying drawings and the description below. Other features, objects, and advantages of the invention will be apparent from the description and drawings, and from the claims.

DESCRIPTION OF DRAWINGS

FIG. 1 shows DNA sequences for various TAL effector endonuclease target sites in FAD3A (SEQ ID NO:1). The underlined sequences indicate target sites for TAL effector endonucleases, designated T01 to T03.

FIG. 2 shows DNA sequences for various TAL effector endonuclease target sites in FAD3B (SEQ ID NO:2). The underlined sequences indicate target sites for TAL effector endonucleases, designated T01 to T03.

FIG. 3 shows DNA sequences for various TAL effector endonuclease target sites in FAD3C (SEQ ID NO:3). The underlined sequences indicate target sites for TAL effector endonucleases, designated T01 to T03.

FIG. 4 shows DNA sequences for various TAL effector endonuclease target sites in FAD2-1A (SEQ ID NO:4). The underlined sequences indicate target sites for TAL effector endonucleases. Lower case letters denote restriction endonuclease sites used to screen for TAL effector endonuclease-induced mutations.

FIG. 5 shows DNA sequences for various TAL effector endonuclease target sites in FAD2-1B (SEQ ID NO:5). The underlined sequences indicate target sites for TAL effector endonucleases. Lower case letters denote restriction endonuclease sites used to screen for TAL effector endonuclease-induced mutations.

FIG. 7 shows representative FAD3A and FAD3B DNA sequences of several confirmed mutant profiles from regenerated T0 plants. The underlined sequences indicate target sites for TAL effector endonucleases. The wild type FAD3A sequence is shown in SEQ ID NO:45, and mutant sequences are shown in SEQ ID NOS:46-52. The wild type FAD3B sequence is shown in SEQ ID NO:53, and the mutant sequences are shown SEQ ID NOS:54-60).

FIG. 8 shows representative FAD2-1A and FAD2-1B DNA sequences of several confirmed mutant profiles from regenerated T0 plants. The underlined sequences indicate target sites for TAL effector endonucleases. The wild type FAD2-1A and FAD2-1B sequences are shown in SEQ ID NO:61, the mutant FAD2-1A sequence is shown in SEQ ID NO:62, and the mutant FAD2-1B sequence is shown in SEQ ID NO:63.

FIG. 10 shows the TAL effector endonuclease target sites for FAD2.

FIG. 11 shows the characteristics of field-grown FAD2-1A FAD2-1B knockout plants compared to a control wild type counterpart.

FIG. 12 shows fatty acid methyl ester (FAME) analysis results for seed oil from field-grown soybean plants of genotype fad2-1a fad2-1b fad3a.

DETAILED DESCRIPTION

Figure 6:
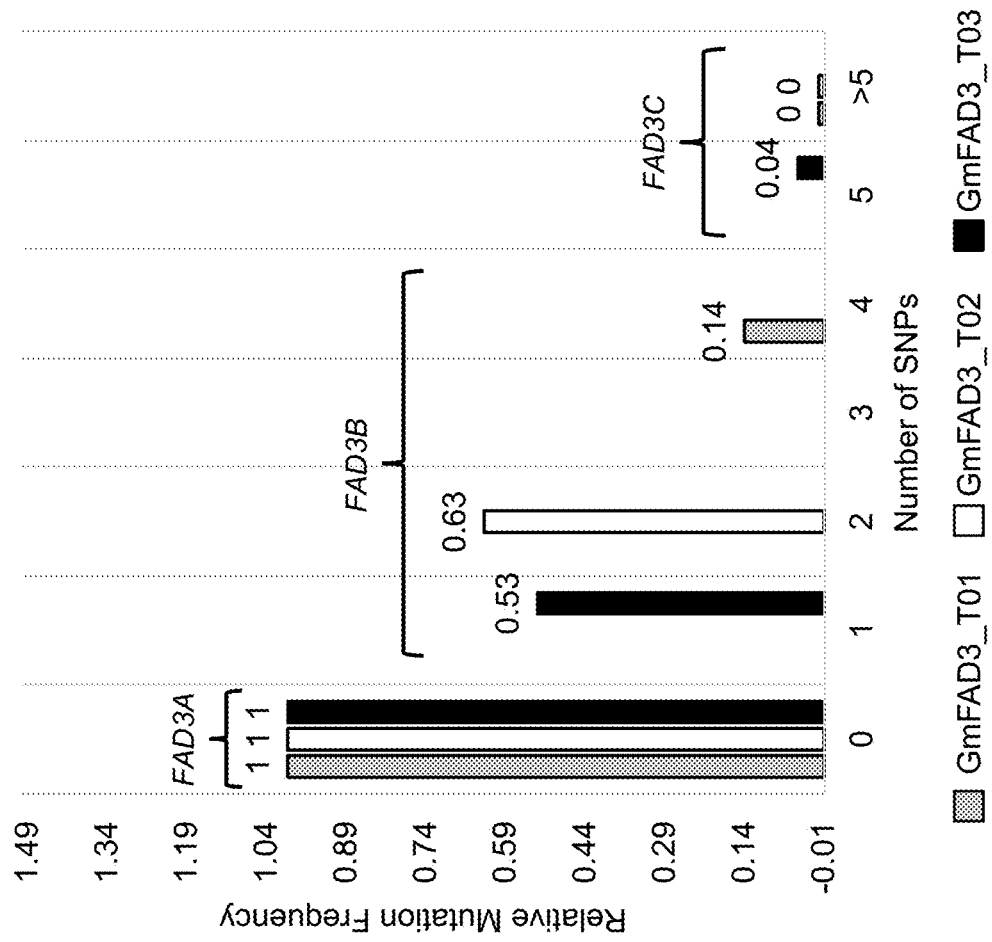
FIG. 6 is a graph plotting TAL effector endonuclease activity relative to the number of SNPs present within the predicted TAL effector endonuclease binding sites.

Commodity soybean oil is made up principally of five fatty acids: palmitic acid (10%), stearic acid (4%), oleic acid (18%), linoleic acid (55%), and linolenic acid (13%). Plant oils with low linolenic acid content may increase the oxidative and frying stability of soybean oil. Such oils also may be healthier, particularly since hydrogenation (a chemically-induced reduction reaction that saturates fatty acids) will reduce the levels of trans fatty acids, which are known to increase risk of heart disease. Traditional breeding, mutagenesis, and siRNA strategies have been used to generate soybean varieties containing reduced levels of linolenic acid. See, e.g., Flores et al., *Transgenic Res* 17:839-850, 2008. Transgenes expressing RNAi constructs are subject to variation in transgene expression, however, and conventional breeding efforts can be a lengthy and costly process.

Enzymes responsible for the biosynthetic progression from palmitic acid to linolenic acid have been identified. For example, the FAD3 enzymes are responsible for converting linoleic acid precursors to linolenic acid precursors during oil accumulation in developing soybean seeds. Due to ancient polyploidization and multiple duplication events, three copies of FAD3 (FAD3A, FAD3B, and FAD3C) exist in the soybean genome. FAD3A and FAD3B have 86% sequence identity at the DNA level, and the encoded proteins have 93% sequence identity at the amino acid level. FAD3A and FAD3C have 89% sequence identity at the DNA level, and the encoded proteins have 77% sequence identity at the amino acid level. FAD3B and FAD3C have 88% sequence identity at the DNA level, and the encoded proteins have 77% sequence identity at the amino acid level. Plants homozygous for naturally occurring FAD3A mutant alleles can have a modest decrease in linolenic acid composition (to about 4% of the total fatty acid content), as described elsewhere (Chappel et al., *Crop Sci.* 47:1705-1710, 2007). FAD3 double mutants have shown decreased linolenic acid (3%) in total seed oil, while mutations in FAD3A, FAD3B, and FAD3C resulted in a further decrease (1%) in linolenic acid content (Bilyeu et al., *Crop Sci.* 51:259-264, 2011).

This document provides soybean plants that have reduced (e.g., decreased or completely abolished) FAD3A, FAD3B, and/or FAD3C activity, as well methods for generating such plants, and oil derived from such plants. In some embodiments, the methods described herein can be used to generate soybean varieties having oil with a decreased linolenic acid component that is 3% or less (e.g., 2.5% or less, 2% or less, 1.5% or less, 1% or less, or 0.5% or less) of the total fatty acid content. In some embodiments, this modification of soybean oil composition can be achieved by completely knocking out expression of the FAD3A, FAD3B, and/or FAD3C genes. According to some of the methods provided herein, both alleles of FAD3A, FAD3B, and/or FAD3C genes are inactivated using non-transgenic techniques. Removing the gene products of FAD3A, FAD3B, and/or FAD3C can severely reduce the conversion of linoleic acid precursors to linolenic acid precursors in soybean seeds.

As used herein, the terms "fatty acid content" and "fatty acid composition" refer to levels of specific fatty acids relative to total fatty acids. "Fatty acid content" and "fatty acid composition" can be represented as a percentage. For example, the overall fatty acid content/fatty acid composition of oil from wild type soybean plants is about 10% palmitic acid, 4% stearic acid, 18% oleic acid, 55% linoleic acid, and 13% linolenic acid. The content of particular fatty acids also can be described related to total fatty acids. For example, the "linolenic acid content" is the level of linolenic acid relative to total fatty acids, such that the "linolenic acid content" within oil from wild type soybean plants is about 13%. Similarly, the "oleic acid content" within oil from wild type soybean plants is about 18%, and the "linoleic acid content" within oil from wild type soybean plants is about 55%.

To accomplish reduced or even complete elimination of FAD3A, FAD3B, and/or FAD3C expression, for example, an engineered, rare-cutting nuclease (e.g., a transcription activator-like (TAL) effector endonuclease) can be designed to recognize a conserved region of all FAD3 genes and create a double-strand break. Improper repair due to Non-Homologous End Joining (NHEJ) at each DNA break site can generate missense and/or nonsense mutations in the FAD3A, FAD3B, and/or FAD3C coding regions, rendering the FAD3A, FAD3B, and/or FAD3C RNA transcripts unstable and targeted for degradation prior to translation.

In soybean, there are at least three members (A, B, and C) of the FAD3 gene family. Representative examples of naturally occurring soybean FAD3A, FAD3B, and FAD3C nucleotide sequences are shown in TABLE 2 (SEQ ID NOS:24, 25, and 26). The soybean plants, cells, plant parts, seeds, and progeny thereof provided herein can have a mutation in each of the endogenous FAD3A, FAD3B, and/or FAD3C alleles, such that expression of each gene is reduced or completely abolished. Alternatively, the soybean plants, cells, plant parts, seeds, and progeny thereof provided herein may have a mutation in at least one FAD3A allele, in at least one FAD3B allele, and/or in at least one FAD3C allele, such that expression of each gene is reduced or completely abolished. The soybean plants, cells, parts, seeds, and progeny can have decreased levels of linolenic acid as compared to wild type soybean plants, cells, parts, seeds, and progeny.

As used herein, the terms "plants" and "plant parts" refer to cells, tissues, organs, seeds, and severed parts (e.g., roots, leaves, and flowers) that retain the distinguishing characteristics of the parent plant. "Seed" refers to any plant structure that is formed by continued differentiation of the ovule of the plant, following its normal maturation point at flower opening, irrespective of whether it is formed in the presence or absence of fertilization and irrespective of whether or not the seed structure is fertile or infertile.

The term "gene" as used herein refers to a nucleic acid sequence that includes a promoter region associated with expression of a gene product. "Gene" also encompasses intron and exon regions associated with expression of the gene product, as well as 5' or 3' untranslated regions associated with expression of the gene product.

The term "allele(s)" means any of one or more alternative forms of a gene at a particular locus. In a diploid (or amphidiploid) cell of an organism, alleles of a given gene are located at a specific location or locus on a chromosome. One allele is present on each chromosome of the pair of homologous chromosomes. "Heterozygous" alleles are two different alleles residing at a specific locus, positioned individually on corresponding pairs of homologous chromosomes. "Homozygous" alleles are two identical alleles residing at a specific locus, positioned individually on corresponding pairs of homologous chromosomes in the cell.

A "wild type" allele or gene refers to an allele or gene that most commonly occurs in nature, and typically is associated with the wild type phenotype. For example, a "wild type FAD3A allele" is a naturally occurring FAD3A allele (e.g., as found within naturally occurring soybean plants) that encodes a functional FAD3A protein. The terms "mutant" and "mutation" are used in connection with alleles, genes, and plant phenotypes that are different from the conventional or wild type alleles, genes, and plant phenotypes that most commonly occur in nature. A mutant plant or allele can occur in the natural population or can be produced by human intervention (e.g., by mutagenesis), and a "mutant allele" refers to an allele having one or more changes in its nucleic acid sequence when compared to the wild type allele, such that it can result in a mutant phenotype either alone or in combination with another mutant allele. In some embodiments, for example, a "mutant FAD3A allele" can be a FAD3A allele that does not encode a functional FAD3A protein; a "mutant FAD3A allele" may include one or more mutations in its nucleic acid sequence that result in no detectable amount of functional FAD3A protein in the plant or plant cell in vivo.

"Mutagenesis" as used herein refers to processes in which mutations are introduced into a selected DNA sequence. Mutations can include one or more deletions, insertions, and/or substitutions. Mutations induced by endonucleases generally are the result of a double strand break, which can yield insertions or deletions ("indels") that are detectable by deep-sequencing analysis. Such mutations typically are deletions of at least several base pairs, and can have the effect of inactivating the mutated allele. A deletion that results in a frameshift, for example, can inactivate an allele. In some cases, mutations can include large deletions that remove all or a portion of a gene of interest. Deletions can range in size from one bp to 1000 bp or more (e.g., one to ten bp, 10 to 20 bp, 20 to 50 bp, 50 to 100 bp, 100 to 200 bp, 200 to 300 bp, 300 to 500 bp, 500 to 1000 bp, or more than 1000 bp). Mutations also can be introduced into a promoter region to decrease or inactivate expression of the corresponding gene. In some of the methods described herein, for example, mutagenesis can occur via double stranded DNA breaks made by TAL effector endonucleases targeted to selected DNA sequences in a plant cell. Such mutagenesis results in "TAL effector endonuclease-induced mutations" (e.g., TAL effector endonuclease-induced knockouts) and reduced expression of the targeted gene. Following mutagenesis, plants can be regenerated from the treated cells using known techniques (e.g., planting seeds in accordance with conventional growing procedures, followed by self-pollination).

As used herein, the phrase "mutation in one or more FAD alleles" refers to one or more FAD (e.g., FAD2 or FAD3) alleles with sequences that are altered such that their expression is reduced, or such that the activity of the encoded FAD protein is reduced, as compared to the corresponding wild type allele or protein. This can occur either by the mutant FAD allele encoding a non-functional FAD protein (e.g., a FAD protein having no biological activity, or a FAD protein with significantly modified or reduced biological activity, as compared to the corresponding wild type FAD protein), or by the mutant FAD allele expressing a significantly reduced amount of functional FAD protein, or no FAD protein at all. As used herein, "significantly" indicates that a result is reproducibly different, typically with a P value<0.05.

A mutation in a FAD nucleic acid sequence can be, for example, a missense mutation, a nonsense mutation, an insertion mutation, a deletion mutation, a frameshift mutation or a splice site mutation, or a combination of the aforementioned mutations.

The term "expression" as used herein refers to the transcription of a particular nucleic acid sequence to produce sense or antisense mRNA, and/or the translation of a sense mRNA molecule to produce a polypeptide, with or without subsequent post-translational events.

The term "reduced" as used herein with regard to expression of a FAD allele or activity of an encoded FAD polypeptide refers to any decrease in expression or activity as compared to that of a corresponding wild type FAD allele or polypeptide. For example, expression or activity can be decreased by at least 1%, at least 3%, at least 5%, at least 10%, at least 20%, at least 25%, at least 50%, at least 75%, at least 80%, at least 90%, at least 95%, or at least 99%, or by 1 to 5%, 5 to 10%, 10 to 20%, 20 to 30%, 30 to 50%, 50 to 70%, 70 to 80%, 80 to 90%, 90 to 95%, or 95 to 100%. "Reducing the expression" of a gene or polypeptide in a plant or a plant cell can be achieved by inhibiting, interrupting, knocking-out, or knocking-down the gene or polypeptide, such that transcription of the gene and/or translation of the encoded polypeptide are reduced as compared to a corresponding wild type plant or plant cell. Expression levels can be assessed using methods such as, for example, reverse transcription-polymerase chain reaction (RT-PCR), Northern blotting, dot-blot hybridization, in situ hybridization, nuclear run-on and/or nuclear run-off, RNase protection, or immunological and enzymatic methods such as ELISA, radioimmunoassay, and western blotting.

The term "reduced" with regard to fatty acid content refers to a fatty acid level that is less than that in oil from a wild type soybean plant. For example, "reduced linolenic acid content" refers to a linolenic acid content that is less than the linolenic acid content found in oil from a wild type soybean plant, and "reduced linoleic acid content" is a linoleic acid content that is less than the linoleic acid content found in oil from a wild type soybean plant. The content of a particular fatty acid can be decreased by at least 1%, at least 3%, at least 5%, at least 10%, at least 20%, at least 25%, at least 50%, at least 75%, at least 80%, at least 90%, at least 95%, or at least 99%, or by 1 to 5%, 5 to 10%, 10 to 20%, 20 to 30%, 30 to 50%, 50 to 70%, 70 to 80%, 80 to 90%, 90 to 95%, or 95 to 100% as compared to the content of that fatty acid in oil from a wild type soybean plant. Thus, the level of linoleic acid in oil from a soybean plant, plant part, or plant cell as provided herein may be 54% or less, 53% or less, 52% or less, 51% or less, 50% or less, 49% or less, 48% or less, 45% or less, 40% or less, 35% or less, 30% or less, 25% or less, 20% or less, 15% or less, 10% or less, 5% or less, or 3% or less of the total fatty acid content. The level of linolenic acid in oil from a soybean plant, plant part, or plant cell as provided herein may be 12.8% or less, 12.5% or less, 12.3% or less, 12% or less, 11.5% or less, 11% or less, 10.5% or less, 10% or less, 9% or less, 8% or less, 7% or less, 6% or less, 5% or less, 4% or less, 3% or less, 2.5% or less, 2% or less, 1.5% or less, 1% or less, or 0.5% or less of the total fatty acid content.

As used herein, the term "increased" with regard to fatty acid content refers to a fatty acid level that is more than that in oil from a wild type soybean plant. For example, "increase oleic acid content" refers to an oleic acid content that is more than the oleic acid content found in oil from a wild type soybean plant. The content of a particular fatty acid can be increased by at least 1%, at least 3%, at least 5%, at least 10%, at least 20%, at least 25%, at least 50%, at least 75%, at least 80%, or at least 90%, or by 1 to 5%, 5 to 10%, 10 to 20%, 20 to 30%, 30 to 50%, 50 to 75%, 75 to 100%, or more than 100% as compared to the content of that fatty acid in oil from a wild type soybean plant. Thus, the level of oleic acid in oil from a soybean plant, plant part, or plant cell as provided herein may be 18.2% or more, 18.5% or more, 18.8% or more, 19% or more, 19.5% or more, 20% or more, 21% or more, 22% or more, 23% or more, 25% or more, 30% or more, 35% or more, 40% or more, 45% or more, 50% or more, 55% or more, 60% or more, 65% or more, 70% or more 75% or more, 80% or more, or 85% or more of the total fatty acid content.

As used herein, a "knockout" or "inactive" allele refers to a mutant allele that is not expressed, or to a mutant allele that encodes a protein without its normal functional activity. Knockout FAD alleles include, for example, deletion mutations of the entire coding region or a substantial part of the coding region, or frameshift or stop-codon mutations that lead to a substantial deletion or entire deletion of the protein. Knockout FAD alleles also encompass alleles having splice site mutations, deletions or insertions in the promoter region, and, with respect to FAD3, alleles with a mutation that removes or replaces any of the eight conserved histidine residues that are present within the FAD3 proteins.

The eight conserved histidine residues are found within region Ia, region Ib, and region II of the FAD3 proteins. The conserved amino acids including the histidine residues within region Ia of the soybean FAD3 genes are HDCGH (SEQ ID NO:4909), which are encoded by the nucleotides beginning at position 286 of SEQ ID NO:24 (FAD3A), the nucleotides beginning at position 298 of SEQ ID NO:25 (FAD3B), and the nucleotides beginning at position 289 of SEQ ID NO:26 (FAD3C). The conserved amino acid sequence that contains the histidines within region Ib of the soybean FAD3 proteins is HRTHH (SEQ ID NO:4910), which is encoded by nucleotides 885-899 of SEQ ID NO:24 (FAD3A), nucleotides 946-960 of SEQ ID NO:25 (FAD3B), and nucleotides 680-694 of SEQ ID NO:26 (FAD3C). The conserved amino acid sequence containing the histidines within region II of the soybean FAD3 proteins is HVTHH (SEQ ID NO:4911), which is encoded by nucleotides 2959-2973 of SEQ ID NO:24 (FAD3A), nucleotides 3034-3048 of SEQ ID NO:25 (FAD3B), and nucleotides 2012-2026 of SEQ ID NO:26 (FAD3C). Mutations that disrupt any of these histidines can result in a knockout FAD3 allele. For example, an in-frame deletion encompassing any of the nucleotides encoding a conserved histidine, a frameshift mutation that occurs before the last conserved histidine, and a missense mutation occurring at any of the codons encoding a conserved histidine will result in a FAD3 knockout allele.

Examples of specific mutations that can be generated in FAD3A include, without limitation, (i) a deletion of the adenine at position 459 of SEQ ID NO:24, (ii) a deletion of the cytosine at position 515 of SEQ ID NO:24, and (iii) a deletion of the adenine at position 894 of SEQ ID NO:24. Examples of specific mutations that can be generated in FAD3B include, without limitation, (i) a deletion of the adenine at position 496 of SEQ ID NO:25, (ii) a deletion of the cytosine at position 552 of SEQ ID NO:25, and (iii) a deletion of the adenine at position 952 of SEQ ID NO:25. Examples of specific mutations that can be generated in FAD3C include, without limitation, a deletion of the adenine at position 686 of SEQ ID NO:26. Such deletions can result in knockout of the FAD3 gene, such as when they are included within a frameshift mutation, or when they are included in an in-frame deletion that removes at least one conserved histidine residue or another conserved portion of the protein, for example.

The term "rare-cutting endonucleases" herein refer to natural or engineered proteins having endonuclease activity directed to nucleic acid sequences having a recognition sequence (target sequence) about 12-40 bp in length (e.g., 14-40 bp in length). Typical rare-cutting endonucleases cause cleavage inside their recognition site, leaving 4 nt staggered cut with 3'OH or 5'OH overhangs. These rare-cutting endonucleases may be meganucleases, such as wild type or variant proteins of homing endonucleases, more particularly belonging to the dodecapeptide family (LAGLI-DADG (SEQ ID NO:107; see, WO 2004/067736) or may result from fusion proteins that associate a DNA binding domain and a catalytic domain with cleavage activity. TAL-effector endonucleases and zinc-finger-nucleases (ZFN) are examples of fusions of DNA binding domains with the catalytic domain of the endonuclease FokI. Customized TAL effector endonucleases are commercially available under the trade name TALEN™ (Cellectis, Paris, France). For a review of rare-cutting endonucleases, see Baker, *Nature Methods* 9:23-26, 2012.

"Rare-cutting endonucleases" also encompass RNA-guided systems that can be used in the methods provided herein. For example, the clustered regularly interspaced short palindromic repeats/CRISPR-associated (CRISPR/Cas) systems use RNA to direct DNA cleavage (see, e.g., Belahj et al., *Plant Methods* 9:39, 2013). These systems consist of a Cas9 endonuclease and a guide RNA [either a complex between a CRISPR RNA (crRNA) and trans-activating crRNA (tracrRNA), or a synthetic fusion between the 3' end of the crRNA and 5' end of the tracrRNA]. The guide RNA directs Cas9 binding and DNA cleavage to sequences that are adjacent to a proto-spacer adjacent motif (PAM; e.g., NGG for Cas9 from *Streptococcus pyogenes*). Once at the target DNA sequence, Cas9 generates a DNA double-strand break at a position three nucleotides from the 3' end of the crRNA sequence that is complementary to the target sequence. As there are several PAM motifs present in the nucleotide sequence of the FAD3 genes, a CRISPR/Cas system may be employed to introduce mutations within the FAD3 genes of *Glycine max* plant cells into which the Cas9 endonuclease and the guide RNA are transfected and expressed. In addition to Cas9, the CRISPR system from *Prevotella* and *Francisella* 1 (Cpf1) can be employed to introduce mutations in the FAD3 genes (see, for example, Zetsche et al., *Cell* 163:759-771, 2015, which are incorporated herein by reference in their entirety). These systems can be used as an alternative to TALE nucleases, to obtain plants and plant parts as described herein.

Thus, in some embodiments, the plants, plant cells, plant parts, seeds, and plant progeny provided herein can be generated using a TAL effector endonuclease system to make targeted knockouts in the FAD3A, FAD3B, and/or FAD3C genes. For example, nucleic acids encoding TAL effector endonucleases targeted to selected FAD3A, FAD3B, or FAD3C sequences (e.g., the FAD3A sequences shown in FIG. 1 and TABLE 1, the FAD3B sequences shown in FIG. 2 and TABLE 1, and/or the FAD3C sequences shown in FIG. 3 and TABLE 1) can be can be transformed into plant cells (e.g., cells in cotyledons), where they can be expressed. Thus, this disclosure provides materials and methods for using TAL effector endonucleases to generate plants and related products (e.g., seeds and plant parts) that are particularly suitable for production of soybean oil with decreased linolenic acid content. Other rare cutting, sequence-specific nucleases can be used to generate the desired plant material, including engineered homing endo-nucleases or zinc finger nucleases.

In some embodiments, the plants, plant parts, and plant cells provided herein also can include a mutation in one or more FAD2 genes. The FAD2 genes are responsible for converting oleic acid precursors to linoleic acid precursors during oil accumulation in developing soybean seeds. Two copies of FAD2 (FAD2-1A and FAD2-1B) exist in the soybean genome. These genes have about 95% sequence identity at the DNA level, and the encoded proteins have about 99% sequence identity at the amino acid level. Plants homozygous for naturally occurring FAD2-1B mutant alleles can have a modest increase (20.5% to 29.4%) in oleic acid composition, as described elsewhere (Pham et al., *BMC Plant Biol.* 10:195, 2010). Mutations in FAD2-1A have been developed through X-ray mutagenesis and TILLING, to produce seeds containing up to 50% oleic acid (Sandhu et al., *JAOCS* 84:229-235, 2007), and mutating both the FAD2-1A and FAD2-1B alleles resulted in oil with an oleic acid content of 82.2% (Pham et al., supra).

Thus, this document also provides soybean plants that have reduced (e.g., lack) FAD2-1A and/or FAD2-1B activity in addition to reduced FAD3A, FAD3B, and/or FAD3C activity. This can be achieved by, for example, knocking out FAD3 in FAD2 mutants, knocking out FAD2 in FAD3 mutants, delivering TAL effector endonucleases that knock out both FAD2 and FAD3, or by crossing. For example, in some embodiments (as for FAD3 targeted mutations), a rare cutting endonuclease (e.g., a TAL effector endonuclease) system can be used to make targeted knockouts in the FAD2-1A and/or FAD2-1B genes. In some embodiments, the soybean plants, cells, plant parts, seeds, and progeny thereof provided herein can have a mutation in each of the endogenous FAD2-1A and FAD2-1B alleles (in addition to a mutation in one or more of the endogenous FAD3 genes), such that expression of each gene is reduced or completely abolished. Alternatively, the soybean plants, cells, plant parts, seeds, and progeny thereof provided herein may have a mutation in at least one FAD2-1A allele and/or in at least one FAD2-1B allele (in addition to a mutation in one or more of the endogenous FAD3 genes), such that expression of each gene is reduced or completely abolished. The soybean plants, cells, parts, seeds, and progeny can have reduced levels of linolenic acid, increased levels of oleic acid, and reduced levels of linoleic acid as compared to wild type soybean plants, cells, parts, seeds, and progeny.

This document also provides methods for generating soybean plants having reduced (e.g., lacking) FAD2-1A and/or FAD2-1B activity in addition to reduced FAD3A, FAD3B, and/or FAD3C activity, as well as oil derived from such plants. In some embodiments, the methods provided herein can be used to produce plant parts (e.g., seeds) or plant products (e.g., oil) having increased oleic acid content, reduced linoleic acid content, and reduced linolenic acid content, as compared corresponding plant parts or products from wild type plants. For example, the methods described herein can be used to generate soybean varieties having oil with a decreased linolenic acid component of 3% or less (e.g., 2.5% or less, 2% or less, 1.5% or less, 1% or less, or 0.5% or less) of the total fatty acid content, as well as an increased oleic acid component of at least 30% (e.g., at least 35%, at least 40%, at least 45%, at least 50%, at least 55%, at least 60%, at least 65%, at least 70%, at least 75%, or at least 80%) of the total fatty acid content, and a reduced linoleic acid component of 10% or less (e.g., 8% or less, 5% or less, 4% or less, 3% or less, 2% or less, 1% or less, or 0.5% or less) of the total fatty acid content.

In some embodiments, the methods provided herein can include using TAL effector endonucleases to generate plants and related products (e.g., seeds and plant parts) that are particularly suitable for production of soybean oil with increased oleic acid content and decreased linoleic acid content, as well as decreased linolenic acid content. For example, nucleic acids encoding TAL effector endonucleases targeted to selected FAD2-1A or FAD2-1B sequences (e.g., the FAD2-1A sequences shown in FIG. 4 and TABLE 3, or the FAD2-1B sequences shown in FIG. 5 and TABLE 3) can be transformed into plant cells (e.g., cells in cotyledons), where they can be expressed. To accomplish the complete elimination of FAD2-1A and FAD2-1B expression, for example, an engineered, rare-cutting nuclease can be designed to recognize a conserved region of both FAD2-1 genes and create a double-strand break. Improper repair due to NHEJ at the DNA break site can generate missense and/or nonsense mutations in the FAD2-1A/1B coding regions, rendering the FAD2-1A/1B RNA transcripts unstable and targeted for degradation prior to translation. Representative examples of naturally occurring soybean FAD2-1A and FAD2-1B nucleotide sequences are shown in TABLE 4 (SEQ ID NOS:43 and 44), and also in SEQ ID NOS:100 and 101. The resulting soybean plants, plant parts, and/or plant cells subsequently can be analyzed to determine whether mutations have been introduced at the target site(s).

The *Glycine max* plants, plant parts, and plant cells provided herein can have mutations in one or more of the FAD3 genes (FAD3A, FAD3B and/or FAD3C). Each FAD3 gene can be in a heterozygous or homozygous state, where the heterozygous state includes one allele with a knockout mutation and one allele without the mutation, and the homozygous state includes two alleles with knockout mutations. Combinations of FAD3 single mutants provided herein are fad3a FAD3B FAD3C, FAD3A fad3b FAD3C, and FAD3A FAD3B fad3c. Combinations of FAD3 double mutants provided herein are fad3a fad3b FAD3C, FAD3A fad3b fad3c, and fad3a FAD3B fad3c. FAD3 triple mutants provided herein are fad3a fad3b fad3c.

This disclosure also provides *Glycine max* plants, plant parts, and plant cells containing a knockout mutation in at least one allele for each of two different FAD2 genes, where the two different FAD2 genes are FAD2-1A and FAD2-1B. The FAD2 genes can be in a heterozygous or homozygous state, where the heterozygous state includes one allele with a knockout mutation and one allele without the mutation, and the homozygous state includes two alleles with knockout mutations. Plants having homozygous knockout mutations in the FAD2-1A and FAD2-1B genes are denoted fad2-1a fad2-1b, with the name of the mutant alleles in lower case.

In addition, this disclosure provides *Glycine max* plants, plant parts, and plant cells with mutations in the FAD2-1A, FAD2-1B, and FAD3 genes. The genotypes of these plants, plant parts, and plant cells can be described as follows: fad2-1a fad2-1b fad3a FAD3B FAD3C, fad2-1a fad2-1b FAD3A fad3b FAD3C, fad2-1a fad2-1b FAD3A FAD3B fad3c, fad2-1a fad2-1b fad3a fad3b FAD3C, fad2-1a fad2-1b fad3a FAD3B fad3c, fad2-1a fad2-1b FAD3A fad3b fad3c, and fad2-1a fad2-1b fad3a fad3b fad3c.

In some embodiments, plants containing a mutation in a FAD2 or FAD3 gene also can contain one or more transgenes. A transgene can be integrated into the soybean genome using standard transformation protocols (see, for example, Rech et al., *Nat Protoc* 3:410-418, 2008; Haun et al., *Plant Biotech J* 12:934-940, 2014; and Curtin et al., *Plant Physiol* 156:466-473, 2011). In some cases, a transgene can encode a protein that confers tolerance or resistance to one or more herbicides (e.g., glufonsinate, mesotrione, imidazolinone, isoxaflutole, glyphosate, 2,4-D, hydroxyphenylpyruvate dioxygenase-inhibiting herbicides, or dicamba). In some cases, a transgene can encode a plant 5-enolpyruvylshikimate-3-phosphate synthase (EPSPS) protein, or a modified plant EPSPS protein, where the modified plant EPSPS contains an amino acid substitution within the conserved TAMRP (SEQ ID NO:4908) sequence. The substitution can be, for example, a threonine to isoleucine substitution, a proline to serine substitution, or a proline to adenine substitution. In some embodiments, a transgene can encode a bacterial EPSPS protein, an *Agrobacterium* CP4 EPSPS protein, an aryloxyalkanoate dioxygenase (AAD) protein, a phosphinothricin N-acetyltransferase (PAT) protein, an acetohydroxyacid synthase large subunit protein, a p-hydroxyphenylpyruvate dioxygenase (hppd) protein, or a dicamba monooxygenase (DMO) protein.

In some cases, a transgene can encode a product that enhances resistance to insects (e.g., lepidopteran insects). For example, a transgene can encode a protein from *Bacillus thuringiensis*, such as a Cry protein (e.g., a Cry1Ac delta-endotoxin protein, a Cry1F delta-endotoxin protein, a Cry2Ab delta-endotoxin protein, or a Cry1Ac delta-endotoxin protein). In some embodiments, a transgene can enhance virus resistance. For example, a transgene can contain a sequence from a viral genome, such as an antisense sequence from a virus genome.

In some embodiments, a transgene can cause male sterility. For example, a transgene can include a pollen killer gene (e.g., an alpha amylase gene, S24 gene, or S35 gene). A transgene can further include a screenable marker, such as a fluorescent protein (e.g., GFP, YFP, RFP, BFP, or luciferase) or a gene involved in regulating seed size. In some cases, a transgene can further include a restoring factor (e.g., a functional male-sterile (MS) gene).

This document also provides FAD2 and FAD3 nucleic acid molecules. In some embodiments, a nucleic acid can have a nucleotide sequence with at least about 75 percent sequence identity to a representative FAD3A, FAD3B, FAD3C, FAD2-1A, or FAD2-1B nucleotide sequence. For example, a nucleotide sequence can have at least 75, at least 80, at least 85, at least 90, at least 91, at least 92, at least 93, at least 94, at least 95, at least 96, at least 97, at least 98, or at least 99 percent sequence identity to a representative, naturally occurring FAD3A, FAD3B, or FAD3C nucleotide sequence as set forth in TABLE 2, or to a representative, naturally occurring FAD2-1A or FAD2-1B nucleotide sequence as set forth in TABLE 4 (SEQ ID NOS:43 and 44). In some embodiments, at least about 1% (e.g., at least 3%, 5%, 10%, or more than 10%) of the nucleotide sequence of a targeted gene can be deleted when generating the mutant.

The percent sequence identity between a particular nucleic acid or amino acid sequence and a sequence referenced by a particular sequence identification number is determined as follows. First, a nucleic acid or amino acid sequence is compared to the sequence set forth in a particular sequence identification number using the BLAST 2 Sequences (Bl2seq) program from the stand-alone version of BLASTZ containing BLASTN version 2.0.14 and BLASTP version 2.0.14. This stand-alone version of BLASTZ can be obtained online at fr.com/blast or at ncbi.nlm.nih.gov. Instructions explaining how to use the Bl2seq program can be found in the readme file accompanying BLASTZ. Bl2seq performs a comparison between two sequences using either the BLASTN or BLASTP algorithm. BLASTN is used to compare nucleic acid sequences, while BLASTP is used to compare amino acid sequences. To compare two nucleic acid sequences, the options are set as follows: -i is set to a file containing the first nucleic acid sequence to be compared (e.g., C:\seq1.txt); -j is set to a file containing the second nucleic acid sequence to be compared (e.g., C:\seq2.txt); -p is set to blastn; -o is set to any desired file name (e.g., C:\output.txt); -q is set to −1; -r is set to 2; and all other options are left at their default setting. For example, the following command can be used to generate an output file containing a comparison between two sequences: C:\Bl2seq c:\seq1.txt -j c:\seq2.txt -p blastn -o c:\output.txt -q -1 -r 2. To compare two amino acid sequences, the options of Bl2seq are set as follows: -i is set to a file containing the first amino acid sequence to be compared (e.g., C:\seq1.txt); -j is set to a file containing the second amino acid sequence to be compared (e.g., C:\seq2.txt); -p is set to blastp; -o is set to any desired file name (e.g., C:\output.txt); and all other options are left at their default setting. For example, the following command can be used to generate an output file containing a comparison between two amino acid sequences: C:\Bl2seq -i c:\seq1.txt -j c:\seq2.txt -p blastp -o c:\output.txt. If the two compared sequences share homology, then the designated output file will present those regions of homology as aligned sequences. If the two compared sequences do not share homology, then the designated output file will not present aligned sequences.

Once aligned, the number of matches is determined by counting the number of positions where an identical nucleotide or amino acid residue is presented in both sequences. The percent sequence identity is determined by dividing the number of matches either by the length of the sequence set forth in the identified sequence (e.g., SEQ ID NO:1), or by an articulated length (e.g., 100 consecutive nucleotides or amino acid residues from a sequence set forth in an identified sequence), followed by multiplying the resulting value by 100. For example, a nucleic acid sequence that has 900 matches when aligned with the sequence set forth in SEQ ID NO:1 is 95.6 percent identical to the sequence set forth in SEQ ID NO:1 (i.e., 900÷941×100=95.6). It is noted that the percent sequence identity value is rounded to the nearest tenth. For example, 75.11, 75.12, 75.13, and 75.14 is rounded down to 75.1, while 75.15, 75.16, 75.17, 75.18, and 75.19 is rounded up to 75.2. It also is noted that the length value will always be an integer.

In some embodiments, the FAD nucleic acid molecules provided herein can include target sequences for rare cutting endonucleases (e.g., TAL effector endonucleases). Methods for selecting endogenous target sequences and generating TAL effector endonucleases targeted to such sequences can be performed as described elsewhere. See, for example, PCT Publication No. WO 2011/072246 (which is incorporated herein by reference in its entirety). TAL effectors are found in plant pathogenic bacteria in the genus *Xanthomonas*. These proteins play important roles in disease, or trigger defense, by binding host DNA and activating effector-specific host genes (see, e.g., Gu et al., *Nature* 435:1122-1125, 2005; Yang et al., *Proc. Natl. Acad. Sci. USA* 103: 10503-10508, 2006; Kay et al. *Science* 318:648-651, 2007; Sugio et al., *Proc. Natl. Acad. Sci. USA* 104:10720-10725, 2007; and Römer et al. *Science* 318:645-648, 2007). Specificity depends on an effector-variable number of imperfect, typically 34 amino acid repeats (Schornack et al., *J. Plant Physiol.* 163:256-272, 2006; and WO 2011/072246). Polymorphisms are present primarily at repeat positions 12 and 13, which are referred to herein as the repeat variable-diresidue (RVD).

The RVDs of TAL effectors correspond to the nucleotides in their target sites in a direct, linear fashion, one RVD to one nucleotide, with some degeneracy and no apparent context dependence. This mechanism for protein-DNA recognition enables target site prediction for new target specific TAL effectors, as well as target site selection and engineering of new TAL effectors with binding specificity for the selected sites.

TAL effector DNA binding domains can be fused to other sequences, such as endonuclease sequences, resulting in chimeric endonucleases targeted to specific, selected DNA sequences, and leading to subsequent cutting of the DNA at or near the targeted sequences. Such cuts (i.e., double-stranded breaks) in DNA can induce mutations into the wild type DNA sequence via NHEJ or homologous recombination, for example. In some cases, TAL effector endonucleases can be used to facilitate site directed mutagenesis in complex genomes, knocking out or otherwise altering gene function with great precision and high efficiency. As described in the Examples below, TAL effector endonucleases targeted to the soybean FAD3A, FAD3B, and FAD3C alleles can be used to mutagenize the endogenous genes, resulting in plants with reduced expression (e.g., without detectable expression) of these genes. The fact that some endonucleases (e.g., FokI) function as dimers can be used to enhance the target specificity of the TAL effector endonuclease. For example, in some cases a pair of TAL effector endonuclease monomers targeted to different DNA sequences (e.g., the underlined target sequences shown in FIGS. 1, 2, and 3) can be used. When the two TAL effector endonuclease recognition sites are in close proximity, as depicted in FIGS. 1-3, the inactive monomers can come together to create a functional enzyme that cleaves the DNA. By requiring DNA binding to activate the nuclease, a highly site-specific restriction enzyme can be created.

Methods for using TAL effector endonucleases to generate plants, plant cells, or plant parts having mutations in endogenous genes include, for example, those described in the Examples herein. For example, nucleic acids encoding TAL effector endonucleases targeted to selected FAD3A, FAD3B, or FAD3C sequences (e.g., the FAD3A sequences shown in FIG. 1 and TABLE 1, the FAD3B sequences shown in FIG. 2 and TABLE 1, and/or the FAD3C sequences shown in FIG. 3 and TABLE 1) can be transformed into plant cells (e.g., cells in cotyledons), where they can be expressed. The cells subsequently can be analyzed to determine whether mutations have been introduced at the target site(s), through nucleic acid-based assays or protein-based assays to detect expression levels as described above, for example, or using nucleic acid-based assays (e.g., PCR and DNA sequencing, or PCR followed by a T7E1 assay; Mussolino et al., *Nucleic Acids Res* 39:9283-9293, 2011) to detect mutations at the genomic loci.

The mutagenized population, or a subsequent generation of that population, can be screened for one or more desired traits (e.g., altered oil composition) that result from the mutations. Alternatively, the mutagenized population, or a subsequent generation of that population, can be screened for a mutation in a FAD3A, FAD3B, or FAD3C gene. For example, the progeny $M_2$ generation of $M_1$ plants may be evaluated for the presence of a mutation in a FAD3A, FAD3B, or FAD3C gene. A "population" is any group of individuals that share a common gene pool. As used herein, "$M_0$" refers to plant cells (and plants grown therefrom) exposed to a TAL effector nuclease, while "$M_1$" refers to seeds produced by self-pollinated $M_0$ plants, and plants grown from such seeds. "$M_2$" is the progeny (seeds and plants) of self-pollinated $M_1$ plants, "$M_3$" is the progeny of self-pollinated $M_2$ plants, and "$M_4$" is the progeny of self-pollinated $M_3$ plants. "$M_5$" is the progeny of self-pollinated $M_4$ plants. "$M_6$", "$M_7$", etc. are each the progeny of self-pollinated plants of the previous generation. The term "selfed" as used herein means self-pollinated.

One or more $M_1$ soybean plants can be obtained from individual, mutagenized $M_0$ plant cells (and plants grown therefrom), and at least one of the plants can be identified as containing a mutation in a FAD3A, FAD3B, or FAD3C gene. An $M_1$ soybean plant may be heterozygous for a mutant allele at a FAD3A, FAD3B, and/or FAD3C locus and, due to the presence of the wild type allele, exhibit delta-fifteen fatty acid desaturase activity. Alternatively, an $M_1$ soybean plant may have a mutant allele at a FAD3A, FAD3B, or FAD3C locus and exhibit the phenotype of lacking delta-fifteen fatty acid desaturase activity. Such plants may be heterozygous and lack delta-fifteen fatty acid desaturase activity due to phenomena such a dominant negative suppression, despite the presence of the wild type allele, or may be homozygous due to independently induced mutations in both alleles at the FAD3A, FAD3B, or FAD3C locus.

A soybean plant carrying mutant FAD3A, FAD3B, and FAD3C alleles can be used in a plant breeding program to create novel and useful lines and varieties. Thus, in some embodiments, an $M_1$, $M_2$, $M_3$, or later generation soybean plant containing at least one mutation in a FAD3A gene, at least one mutation in a FAD3B gene, and at least one mutation in a FAD3C gene can be crossed with a second soybean plant, and progeny of the cross can be identified in which the FAD3A, FAD3B, and FAD3C gene mutations are present. It is to be appreciated that the second soybean plant can contain the same FAD3A, FAD3B, and FAD3C mutations as the plant to which it is crossed, different FAD3A, FAD3B, and FAD3C mutations, or can be wild type at the FAD3A, FAD3B, and/or FAD3C loci.

It also should be appreciated that the mutagenized soybean population can be combined with other previously identified mutations, to yield increased agronomically valuable traits. For example, a FAD3A, FAD3B, and/or FAD3C mutant can be combined with a FAD2 mutant soybean plant. Such a combinatorial mutant may further increase the value of the oil profile. This combination can be obtained either by utilizing mutant plants as the material for FAD3A, FAD3B, and/or FAD3C mutagenesis, or through breeding programs.

Breeding can be carried out via known procedures. DNA fingerprinting, SNP or similar technologies may be used in a marker-assisted selection (MAS) breeding program to transfer or breed mutant FAD3A, FAD3B, and FAD3C alleles into other soybean plants. For example, a breeder can create segregating populations from hybridizations of a genotype containing a mutant allele with an agronomically desirable genotype. Plants in the $F_2$ or backcross generations can be screened using markers developed from FAD3A, FAD3B, and FAD3C sequences or fragments thereof. Plants identified as possessing the mutant allele can be backcrossed or self-pollinated to create a second population to be screened. Depending on the expected inheritance pattern or the MAS technology used, it may be necessary to self-pollinate the selected plants before each cycle of backcrossing to aid identification of the desired individual plants. Backcrossing or other breeding procedure can be repeated until the desired phenotype of the recurrent parent is recovered.

Successful crosses yield $F_1$ plants that are fertile and that can be backcrossed with one of the parents if desired. In some embodiments, a plant population in the $F_2$ generation can be screened for FAD3A, FAD3B, and FAD3C gene expression. For example, a plant can be identified that fails to express FAD3A, FAD3B, and FAD3C due to the presence of mutations within the FAD3A, FAD3B, and FAD3C genes, using standard methods such as, for example, a PCR method with primers based on the nucleotide sequence information for FAD3A, FAD3B, and FAD3C described herein. Selected plants then can be crossed with one of the parents and the first backcross ($BC_1$) generation plants are self-pollinated to produce a $BC_1F_2$ population that is again screened for variant FAD3A, FAD3B, and FAD3C gene expression (e.g., null versions of the FAD3A, FAD3B, and FAD3C genes). The process of backcrossing, self-pollination, and screening is repeated, for example, at least four times until the final screening produces a plant that is fertile and reasonably similar to the recurrent parent, such that it has acceptable agronomic performance. This plant, if desired, can be self-pollinated, and the progeny subsequently can be screened again to confirm that the plant lacks FAD3A, FAD3B, and FAD3C gene expression. Cytogenetic analysis of the selected plants optionally can be performed to confirm the chromosome complement and chromosome pairing relationships. Breeder's seed of the selected plant can be produced using standard methods including, for example, field testing, confirmation of the null condition for FAD3A, FAD3B, and FAD3C, and/or analyses of oil to determine the level of linolenic acid.

In situations where the original $F_1$ hybrid resulting from the cross between a first, mutant soybean parent and a second, wild type soybean parent, is hybridized or back-crossed to the mutant soybean parent, the progeny of the backcross can be self-pollinated to create a $BC_1F_2$ generation that is screened for the mutant FAD3A, FAD3B, and FAD3C alleles.

A plant breeding program using the mutant soybean plants described herein can result in novel and useful lines and varieties. As used herein, the term "variety" refers to a population of plants that share constant characteristics that separate them from other plants of the same species. A variety is often, although not always, sold commercially. While possessing one or more distinctive traits, a variety can be further characterized by a very small overall variation between individuals within that variety. A "pure line" variety may be created by several generations of self-pollination and selection, or vegetative propagation from a single parent using tissue or cell culture techniques. A variety can be essentially derived from another line or variety. As defined by the International Convention for the Protection of New Varieties of Plants (Dec. 2, 1961, as revised on Nov. 10, 1972, on Oct. 23, 1978, and on Mar. 19, 1991), a variety is "essentially derived" from an initial variety if (a) it is predominantly derived from the initial variety, or from a variety that is predominantly derived from the initial variety, while retaining expression of the essential characteristics that result from the genotype or combination of genotypes of the initial variety, (b) it is clearly distinguishable from the initial variety, and (c) except for the differences that result from the act of derivation, it conforms to the initial variety in the expression of essential characteristics that result from the genotype or combination of genotypes of the initial variety. Essentially derived varieties can be obtained, for example, by selection of a natural or induced mutant, a somaclonal variant, a variant individual from plants of the initial variety, backcrossing, or transformation. A "line" as distinguished from a variety most often denotes a group of plants used non-commercially, for example in plant research. A line typically displays little overall variation between individuals for one or more traits of interest, although there may be some variation between individuals for other traits.

The methods provided herein can be used to produce plant parts (e.g., seeds) or plant products (e.g., oil) having decreased linolenic acid content, as compared corresponding plant parts or products from wild type plants. The fatty acid content of a plant part or a plant product can be evaluated using standard methods, such as those described in Example 6 herein, for example.

Any of the plants or plant parts of the present disclosure, containing combinations of mutations in the FAD2 and/or FAD3 genes, can be processed to produce a feed, meal, protein, or oil. In some embodiments, the feed, meal, protein, or oil preparation can be for livestock animals, fish, or humans, or a combination thereof. Methods for producing feed, meal, protein, and oil are known in the art. See, for example, U.S. Pat. Nos. 4,957,748, 5,100,679, 5,219,596, 5,936,069, 6,005,076, 6,146,669, and 6,156,227, all of which are incorporated herein by reference in their entirety.

Oil generated from the plants and plant parts provided herein can be blended with other oils. In some embodiments, the oil produced from plants provided herein, or generated using a method described herein, can constitute at least 1% (e.g., at least 5%, 10%, 25%, 50%, 75%, or 90%) by volume or weight of the oil component of any product. In some embodiments, the oil can be blended, and can constitute at least 10% (e.g., at least 25%, 35%, 50%, or 75%) of the blend by volume. Oil generated from plants provided herein also can be admixed with one or more organic solvents or petroleum distillates.

The soybean oil can be a crude soybean oil, or can be a processed soybean oil. The soybean oil can be refined, bleached, deodorized, and/or winterized. As used herein, "refining" refers to a process of treating natural or processed fat or oil to remove impurities, which can be accomplished by treating fat or oil with caustic soda, followed by centrifugation, washing with water, and heating under vacuum. "Bleaching" refers to a process of treating a fat or oil to remove or reduce the levels of coloring materials in the fat or oil. Bleaching can be achieved by treating fat or oil with activated charcoal or diatomaceous earth. "Deodorizing" refers to a process of removing components from a fat or oil that contribute flavors or odors (e.g., objectionable flavors or odors) to the end product, and can be accomplished using of high vacuum and superheated steam washing. "Winterizing" refers to a process of removing saturated glycerides from an oil, and can be accomplished by chilling and removing solidified portions of fat from an oil.

Soybean oil generated from the plants and plant parts provided herein can be well-suited for use in cooking and frying. Due to reduced levels of polyunsaturated fatty acid content, oil generated from the plants and plant parts provided herein may not require extensive processing, compared to that of conventional soybean oils, because fewer unwanted compounds may be present.

Soybean oil generated from the plants and plant parts provided herein can be well-suited for use as a salad oil, and also may be well-suited for use in shortening, margarine, and other semi-solid vegetable fats used in foodstuffs. Production of these types of fats typically involves hydrogenation of unsaturated oils. Due to the increased oxidative stability of the present oil, the oil does not need to be hydrogenated to the extent of conventional oils for uses such as margarine and shortening, thereby reducing processing costs and the production of unhealthy trans fats.

Soybeans, and oils generated from the soybean plants and plant parts provided herein also can be well-suited for use in soyfoods made from whole soybeans, such as soymilk, soy nut butter, natto, and tempeh, and soyfoods made from processed soybeans and soybean oil, including soybean meal, soy flour, soy protein concentrate, soy protein isolates, texturized soy protein concentrate, hydrolyzed soy protein, whipped topping, cooking oil, salad oil, shortening, and lecithin.

Whole soybeans generated from the plants and provided herein also can be edible, and can be sold to consumers raw, roasted, or as edamame. Soymilk, which typically is produced by soaking and grinding whole soybeans, can be consumed as is, or can be spray-dried, or processed to form soy yogurt, soy cheese, tofu, or yuba. The soybeans and soybean oil provided herein can be particularly useful in these and other soyfoods (as compared to conventional soybeans or soybean oil) due to their improved oxidative stability.

Seeds of the plants described herein can be placed or stored in a container. As used herein, a container is an object capable of holding such seeds. A container can contain about 100, 500, 1,000, 2,000, 5,000, 10,000, 25,000, 40,000, or more than 40,000 seeds.

The invention will be further described in the following examples, which do not limit the scope of the invention described in the claims.

EXAMPLES

Example 1—Engineering Sequence-Specific Nucleases to Mutagenize the FAD3A, FAD3B, and FAD3C Genes To completely inactivate or knock out the alleles of FAD3A, FAD3B, and FAD3C genes in G. max, sequence-specific nucleases were designed that target the nucleic acid sequence encoding conserved histidine cluster motifs required for catalytic activity. Nine TAL effector endonuclease pairs were designed to target the FAD3 gene family (i.e., three TAL effector endonuclease pairs for each FAD3 gene), using software that specifically identifies TAL effector endonuclease recognition sites, such as TALE-NT 2.0 (Doyle et al., Nucleic Acids Res 40:W117-122, 2012). TAL effector endonuclease recognition sites for the FAD3A gene are underlined in FIG. 1, TAL effector endonuclease recognition sites for the FAD3B gene are underlined in FIG. 2, and TAL effector endonuclease recognition sites for the FAD3C gene are underlined in FIG. 3; these also are listed in TABLE 1. TAL effector endonucleases were synthesized using methods similar to those described elsewhere (Cermak et al., Nucleic Acids Res 39:e82, 2011; Reyon et al., Nat Biotechnol 30:460-465, 2012; and Zhang et al., Nat Biotechnol 29:149-153, 2011). The TAL effector endonuclease pairs targeting FAD3 sequence are referred to as GmFAD3_T01, GmFAD3_T02, and GmFAD3_T03. GmFAD3_T01 may also referred to as GmFAD3_T01.1. GmFAD3_T02 may also referred to as GmFAD3_T02.1. GmFAD3_T03 may also referred to as GmFAD3_T03.1.

Example 2—FAD3A TAL Effector Endonuclease Activity in Soybean Protoplasts

To assess the activity of the TAL effector endonucleases targeting the FAD3A gene, NHEJ frequencies were assessed via deep sequencing of transformed soybean protoplasts. TAL effector endonuclease activity at endogenous target sites in G. max was measured by expressing the TAL effector endonucleases in protoplasts and surveying the TAL effector endonuclease target sites for mutations introduced by NHEJ. Briefly, G. max immature seeds were taken from 60 to 80 day old plants under high light conditions. Protoplasts were isolated according to the aforementioned methods described by Dhir et al., Plant Cell Reports 10:39-43, 1991.

TAL effector endonuclease-encoding plasmids, together with a YFP-encoding plasmid, were introduced into G. max protoplasts by PEG-mediated transformation as described elsewhere (Yoo et al., Nature Protocols 2:1565-1572, 2007). Twenty-four hours after treatment, transformation efficiency was measured by evaluating an aliquot of the transformed protoplasts using a fluorescent microscope to monitor YFP fluorescence. Transformation efficiency was determined to be 90%. The remainder of the transformed protoplasts were harvested, and genomic DNA was prepared by a salt-extraction based method (Ajanabi et al., Nucl. Acids Res. 25(22):4692-4693, 1997). Using the genomic DNA prepared from the protoplasts as a template, a fragment encompassing the TAL effector endonuclease recognition site was amplified by PCR. The PCR product was then subjected to 454 pyro-sequencing. Sequencing reads with insertion/deletion (indel) mutations in the spacer region were considered as having been derived from imprecise repair of a cleaved TAL effector endonuclease recognition site by NHEJ. Mutagenesis frequency was calculated as the number of sequencing reads with NHEJ mutations out of the total sequencing reads. The values were then normalized by the transformation efficiency.

The raw activity of the GmFAD3 TAL effector endonuclease pairs, GmFAD3A_T01, GmFAD3A_T02, and GmFAD3A_T03, against FAD3A, FAD3B, and FAD3C are summarized in TABLE 5. TAL effector endonucleases GmFAD3A_T02 had the highest activity at the intended target FAD3A (14.48%) and decreased activity at FAD3B and FAD3C (8.81% and 0.01%, respectively).

A correlation was observed between the number of SNPs within the TAL effector endonuclease binding sites and the relative mutation frequencies (FIG. 6). Raw mutation frequencies at FAD3A target sites (containing 0 SNPs) for TAL effector endonuclease pairs GmFAD3_T01, GmFAD3_T02, GmFAD3_T03 were 10.15%, 14.48% and 2.39%, respectively. After normalizing TAL effector endonuclease mutation frequencies at FAD3A, the relative mutation frequencies at FAD3B and FAD3C were determined. Target sites with one or two SNPs decreased mutation frequencies to ~53 or 63%, respectively, relative to the activity of the corresponding TAL effector endonuclease at FAD3A; target sites with four SNPs decreased mutation frequencies to 14%; target sites with five SNPs decreased mutation frequencies to 0.041%, and target sites with more than five SNPs decreased mutation frequencies to undetectable levels. Whereas these data do not account for relative position of the SNPs, they provide evidence for TAL effector endonuclease target site specificity, indicating that target sites with five or more SNPs are unlikely to be recognized and cleaved.

FAD3 mutations within soybean protoplasts, which were introduced using the FAD3A TALE nuclease pairs, were further analyzed. Both insertions and deletions were observed, with the majority of the mutations being deletions. A list of the TAL effector endonuclease-induced FAD3 mutations identified in soybean cells is provided by SEQ ID NOS:109-4901. Specific mutations introduced into FAD3A by GmFAD3_T01.1 are set forth in the sequences of SEQ ID NOS:109-1140. Specific mutations introduced into FAD3B by GmFAD3_T01.1 are set forth in the sequences of SEQ ID NOS:1141-1372. Specific mutations introduced into FAD3A by GmFAD3_T02.1 are set forth in the sequences of SEQ ID NOS:1373-3116. Specific mutations introduced into FAD3B by GmFAD3_T02.1 are set forth in the sequences of SEQ ID NOS:3117-4048. Specific mutations introduced into FAD3A by GmFAD3_T03.1 are set forth in the sequences of SEQ ID NOS: 4049-4607. Specific mutations introduced into FAD3B by GmFAD3_T03.1 are set forth in the sequences of SEQ ID NOS:4608-4884. Specific mutations introduced into FAD3C by GmFAD3_T03.1 are set forth in the sequences of SEQ ID NOS: 4885-4901. It was observed that the majority of mutations included a deletion of the nucleotide at position 9 of the 17 nucleotide spacer. Specifically, using TAL endonuclease pair GmFAD3_T01.1, a deletion of the adenine nucleotide at position 459 of SEQ ID NO:24 (FAD3A) was observed. Using TAL endonuclease pair GmFAD3_T02.1, a deletion of the cytosine nucleotide at position 515 of SEQ ID NO:24 (FAD3A) was observed. Using TAL endonuclease pair GmFAD3_T03.1, a deletion of the adenine nucleotide at position 894 of SEQ ID NO:24 (FAD3A) was observed. Using TAL endonuclease pair GmFAD3_T01.1, a deletion of the adenine nucleotide at position 496 of SEQ ID NO:25 (FAD3B) was observed. Using TAL endonuclease pair GmFAD3_T02.1, a deletion of the cytosine nucleotide at position 552 of SEQ ID NO:25 (FAD3B) was observed. Using TAL endonuclease pair GmFAD3_T03.1, a deletion of the adenine nucleotide at position 952 of SEQ ID NO:25 (FAD3B) was observed. Using TAL endonuclease pair GmFAD3_T03.1, a deletion of the adenine nucleotide at position 686 of SEQ ID NO:26 (FAD3C) was observed.

Example 3—Regeneration of Soybean Plants with TAL Effector Endonuclease-Induced Mutations in FAD3 Genes Following verification that FAD3 TAL effector endonuclease created targeted modifications at endogenous target sites, experiments were conducted to create soybean plants with mutations in FAD3A, FAD3B, and FAD3C. To accomplish this, each of the FAD3 TAL effector endonuclease pairs was cloned into a bacterial vector, with TAL effector endonuclease expression driven by the cauliflower mosaic virus 35S promoter. Such vectors can be delivered to plant cells by *Agrobacterium*-mediated transformation or by using biolistics.

Transgenic soybean plants expressing the TAL effector endonucleases were generated using standard transformation protocols (Rech et al., *Nat Protoc* 3:410-418, 2008; Haun et al., *Plant Biotech J* 12:934-940, 2014; and Curtin et al., *Plant Physiol* 156:466-473, 2011). Following transformation of soybean half cotyledons (variety Bert) with sequences encoding the GmFAD3_T02 TAL effector endonuclease, putatively transgenic plants were regenerated. Both WT and FAD2-1A, FAD2-1B mutant soybean lines were transformed. The plants were transferred to soil, and after approximately 4 weeks of growth, a small leaf was harvested from each plant for DNA extraction and genotyping. From four independent transformations (designated as experiments Gm183, Gm184, Gm205, and Gm206), a total of 72 events were generated. All T0 transgene-positive plants were then subjected to a T7 Endonuclease 1 (T7E1) assay to identify plants with mutations at the FAD3A, FAD3B, and/or FAD3C TAL effector endonuclease recognition sites (Kim et al., *Genome Res.* 19:1279-1288, 2009). Briefly, a PCR product spanning the TAL effector endonuclease recognition site was generated, denatured, and allowed to reanneal. T7E1 was added to the annealed products to cleave heteroduplexes generated when a wild type DNA fragment annealed with a fragment carrying a TAL effector endonuclease-induced mutation, and cleavage products were visualized by agarose gel electrophoresis. Alternatively, the PCR amplicons could be directly sequenced to assess whether mutations have occurred at the FAD3A, FAD3B and/or FAD3C target sites.

The T7E1 assay revealed that out of the 72 transgene-positive plants screened, 16 plants were positive for mutations at the target site. The FAD3A and FAD3B PCR amplicons of the 16 positive plants were then inserted into cloning vectors and subjected to Sanger sequencing to confirm and characterize the mutant profiles. The resulting reads were then aligned to the wild type sequences to determine allele types. The results are summarized in TABLE 6, and representative sequences are shown in FIG. 7. Together, these results confirmed the successful mutagenesis of FAD3 within T0 soybean plants, with TAL effector endonuclease GmFAD3_T02 mutagenesis frequencies at FAD3A of about 22 percent.

To confirm that TAL effector endonuclease-induced mutations can be stably transmitted to subsequent generations, candidate T1 plants derived from experiment Gm183 were screened for mutations within FAD3A by PCR amplification and sequencing of clones. From three different T0 events (Gm183-4, Gm183-5 and Gm183-6), T1 plants harboring heterozygous or homozygous mutations within FAD3A were identified, indicating that mutations were stably transmitted to the next generation. No plants with combinations of FAD3A and FAD3B mutations were identified, indicating that the frequency of mutagenesis at FAD3B was <1.4% (i.e., less than 1 out of 72 events).

Sanger sequencing reads containing mutations within FAD3A were aligned to the wild type sequences to determine allele types. The results are summarized in TABLE 7. A listing of mutations identified within FAD3A is shown within SEQ ID NOS:64-90 and SEQ ID NOS:102-106.

Example 4—Regeneration of Soybean Plants with TAL Effector Endonuclease-Induced Mutations in FAD2 and FAD3 Genes An alternative approach to knock out FAD2 and FAD3 genes is to simultaneously deliver two TAL effector endonucleases targeting sequence within the FAD2-1A, FAD2-1B (one TAL effector endonuclease), and FAD3 genes (the other TAL effector endonuclease). Following verification that FAD2 and FAD3 TAL effector endonuclease created targeted modifications at endogenous target sites, experiments are conducted to create soybean plants with mutations in FAD2-1A, FAD2-1B, FAD3A, FAD3B, and FAD3C. To accomplish this, each of the FAD2 and FAD3 TAL effector endonucleases are cloned into a T-DNA vector, and TAL effector endonuclease expression is driven by the cauliflower mosaic virus 35S promoter (Zuo et al., supra). The T-DNA vector also contains a selectable marker that confers resistance to glufosinate. Such vectors are delivered to plant cells by *Agrobacterium*-mediated transformation or by using biolistics. Transgenic soybean plants expressing the TAL effector endonucleases are generated using standard *Agrobacterium rhizogenes* transformation protocols (Curtin et al., supra). Following cultivation of the T-DNA-containing *A. rhizogenes* strains with soybean half cotyledons (variety Bert), putatively transgenic plants are regenerated. The plants are transferred to soil, and after approximately 4 weeks of growth, a small leaf is harvested from each plant for DNA extraction and genotyping. Each DNA sample is first screened using PCR for the presence of T-DNA. All T-DNA-positive plants are then subjected to a T7 Endonuclease 1 (T7E1) assay to identify plants with mutations at the FAD2-1A, FAD2-1B, FAD3A, FAD3B, and/or FAD3C TAL effector endonuclease recognition sites (Kim et al., *Genome Res.* 19:1279-1288, 2009). Briefly, a PCR product spanning the TAL effector endonuclease recognition site is generated, denatured, and allowed to reanneal. T7E1 is added to the annealed products to cleave heteroduplexes generated when a wild type DNA fragment annealed with a fragment carrying a TAL effector endonuclease-induced mutation, and cleavage products are visualized by agarose gel electrophoresis. Alternatively, the PCR amplicons can be directly sequenced to assess whether mutations occurred at the FAD2-1A, FAD2-1B, FAD3A, FAD3B and/or FAD3C target sites.

Example 5—Crossing of Soybean Plants with TAL Effector Endonuclease-Induced Mutations in FAD2 and/or FAD3 Genes to Produce Combinatorial Mutants Following verification that soybean plants with mutations in FAD2-1A, FAD2-1B (FIG. 8), FAD3A, FAD3B, and FAD3C have been generated, the mutant plants are subjected to crossing to yield combinatorial mutants of FAD2-1A, FAD2-1B, FAD3A, FAD3B, and/or FAD3C. This is accomplished by acquiring pollen from a young flower that has opened for the first time; the flower is separated and collected to transfer the desired pollen to the stigma. The resulting progeny are then genotyped to confirm successful crosses.

Example 6—Fatty Acid Profile Analysis on Seeds Produced from TAL Effector Endonuclease-Induced Mutations in Soybean FAD3 Genes Soybean lines are grown to maturity and allowed to self-fertilize, giving rise to seeds that are homozygous mutant in either FAD3A (designated aaBBCC), FAD3B (designated AAbbCC), FAD3C (designated AABBcc), FAD3A and FAD3B (designated aabbCC), FAD3B and FAD3C (designated AAbbcc), or FAD3A, FAD3B, and FAD3C (designated aabbcc). These seeds are analyzed for fatty acid composition. Briefly, individual soybean seeds are pulverized, and DNA is prepared from a portion of the ground tissue and analyzed to establish the genotype of each seed. The remaining pulverized tissue from FAD3A homozygous (aaBBCC), FAD3B homozygous (AAbbCC), FAD3C homozygous (AABBcc), FAD3A and FAD3B homozygous (aabbCC), FAD3B and FAD3C homozygous (AAbbcc), or FAD3A, FAD3B, and FAD3C homozygous (aabbcc) knockout seeds is used to determine fatty acid composition using fatty acid methyl esters (FAME) gas chromatography (Beuselinck et al., *Crop Sci.* 47:747-750, 2006). The results of the analysis likely show that the single mutant has a modest reduction in linolenic acid, whereas the double and triple mutants are likely to show a more significant reduction.

Figure 9:
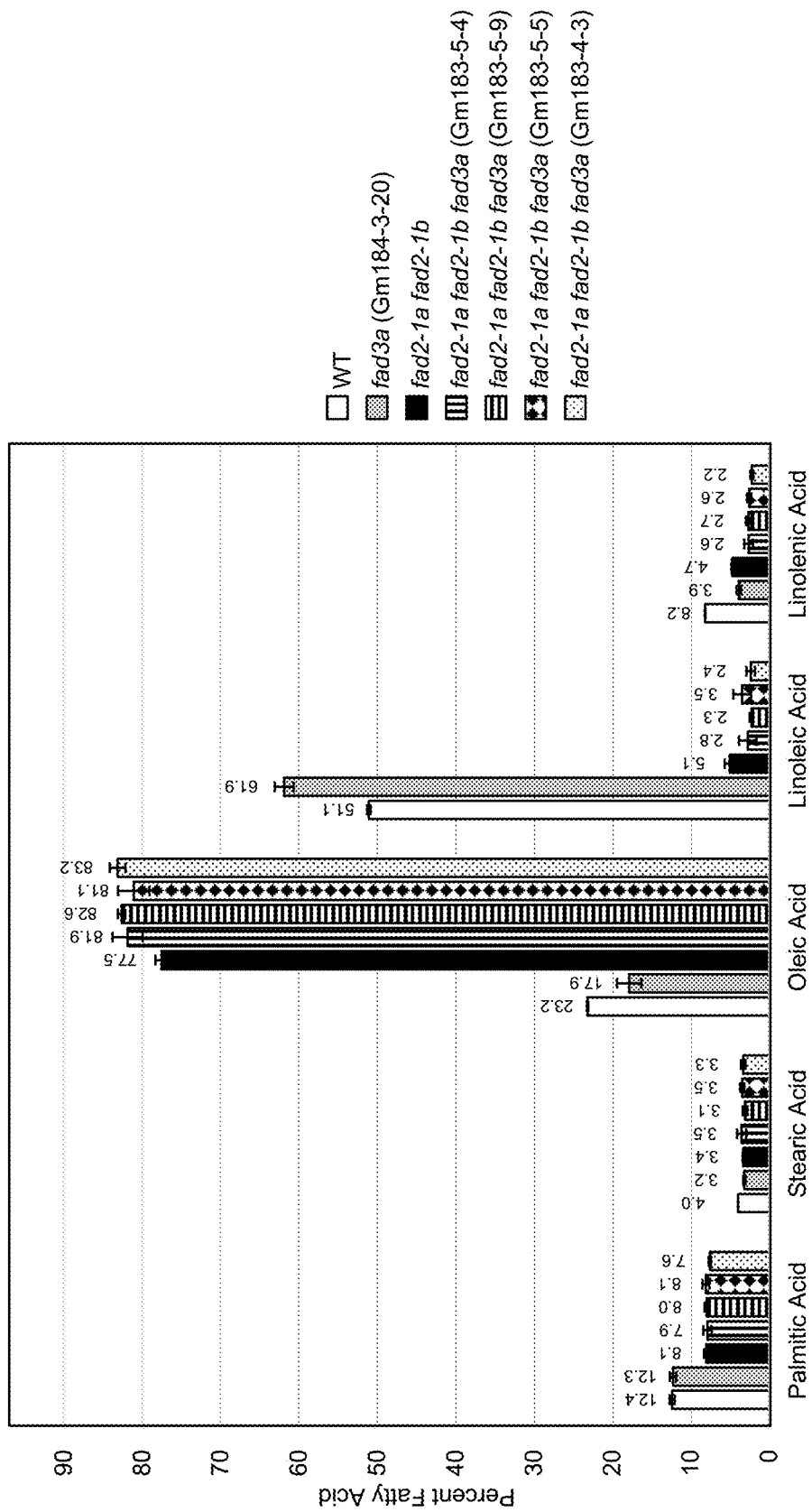
FIG. 9 is a graph plotting the fatty acid profile from fad2-1a fad2-1b fad3a mutant soybean plants. Error bars represent standard deviation of four or more biological replicates. Oil from T2 seed from four different T1 fad2-1a fad2-1b fad3a mutant lines was analyzed. The genotypes for the fad2-1a fad2-1b fad3a plant lines at the fad3a TAL effector endonuclease target site were −7 bp/−7 bp (Gm183-4-3), −43 bp/−43 bp (Gm183-5-4), −43 bp/−43 bp (Gm183-5-5), and −43 bp/−43 bp (Gm183-5-9). The genotype for the fad3a plant line was −4 bp/−4 bp (Gm184-3-20).

Example 7—Oil from FAD2-1A FAD2-1B FAD3A Homozygous Mutant Soybean Seeds Contains High Oleic, Low Linoleic, and Low Linolenic Acid The oil profile from seed was assessed from FAD3A mutant soybean plants (designated as fad3a) and FAD2-1A FAD2-1B FAD3A homozygous mutant soybean plants (designated as fad2-1a fad2-1b fad3a) (FIG. 9). Seed from T1 homozygous mutant lines were collected and assessed for oil composition by gas chromatographic analysis of fatty acid methyl esters (GC FAME Analysis). Significant changes in linolenic and linolenic acid levels were observed in oil from fad3a plants, relative to oil from WT plants: linolenic acid levels decreased from 8.2±0.4% to 3.9±0.3%, while linoleic acid levels increased from 51.1±0.2% to 61.9±1.2%. Surprisingly, significant changes in the levels of oleic and stearic acid levels also were observed: oleic acid levels decreased from 23.2±0.8% to 17.9±1.6%, and stearic acid levels decreased from 4±0.01% to 3.2±0.1%.

Specifically, five biological replicates of seeds from fad3a plants were found to have linolenic acid levels of 3.8%, 4.3%, 3.9%, 3.8%, and 3.5%; linoleic acid levels of 63.0%, 63.2%, 61.2%, 60.4%, and 61.9%; oleic acid levels of 17.2%, 15.6%, 18.6%, 19.4%, and 18.9%; stearic acid levels of 3.2%, 3.4%, 3.0%, 3.0%, and 3.1%; and palmitic acid levels of 12.0%, 12.6%, 12.4%, 12.6% and 11.7%.

Four biological replicates of WT seed were found to have linolenic acid levels of 8.2%, 8.2%, 8.1%, and 8.2%; linoleic acid levels of 51.2%, 51.0%, 50.9%, and 51.4%; oleic acid levels of 23.2%, 23.3%, 23.2%, and 23.3%; stearic acid levels of 4.0%, 4.0%, 4.0%, and 4.0%; and palmitic acid levels of 12.4%, 12.5%, 12.8%, and 12.0%.

Significant changes in fatty acid levels within seed oil from fad2-1a fad2-1b fad3a soybean plants also were observed as compared to the fatty acid levels within fad2-1a fad2-1b soybean plants (FIG. 9). The average linolenic acid level within oil from fad2-1a fad2-1b fad3a plants was 2.5±0.4%, significantly lower than oil from fad2-1a fad2-1b soybean plants (4.7±0.1%). Further, and surprisingly, linoleic acid levels decreased from 5.1±0.7% in fad2-1a fad2-1b lines to 2.7±0.9% in fad2-1a fad2-1b fad3a lines, and oleic acid levels increased from 77.5±0.8% in fad2-1a fad2-1b lines to 82.2±1.6% in fad2-1a fad2-1b fad3a lines. Together, these results indicate that stacking mutations within the FAD2-1 and FAD3A genes can decrease linolenic and linoleic acid levels to below 3%, and increases oleic acid levels to over 80%.

Specifically, 20 biological replicates of seeds from fad2-1a fad2-1b fad3a plants were found to have linolenic acid levels of 1.9%, 3.1%, 2.2%, 2.8%, 3.2%, 2.6%, 2.8%, 3.0%, 2.7%, 2.1%, 2.0%, 2.1%, 2.2%, 2.3%, 2.5%, 2.9%, 2.8%, 2.3%, 2.5%, and 2.3%; linoleic acid levels of 1.6%, 4.6%, 2.5%, 2.6%, 2.5%, 2.6%, 2.3%, 2.0%, 2.2%, 2.3%, 1.8%, 2.1%, 2.1%, 3.0%, 2.9%, 5.0%, 4.3%, 2.6%, 3.2% and 2.3%; oleic acid levels of 84.3%, 78.9%, 82.0%, 82.1%, 82.2%, 82.0%, 83.1%, 82.5%, 82.4%, 83.2%, 84.2%, 83.7%, 83.6%, 82.3%, 81.9%, 78.6%, 79.5%, 82.7%, 81.5% and 83.2%; stearic acid levels of 3.4%, 3.5%, 4.6%, 3.3%, 3.1%, 3.5%, 2.7%, 3.1%, 3.0%, 3.3%, 3.1%, 3.2%, 3.1%, 3.6%, 3.6%, 3.7%, 3.7%, 3.4%, 3.5% and 3.0%; and palmitic acid levels of 7.5%, 8.6%, 7.3%, 8.0%, 8.1%, 8.0%, 8.0%, 8.1%, 8.4%, 7.7%, 7.7%, 7.5%, 7.6%, 7.4%, 7.7%, 8.6%, 8.5%, 7.6%, 7.9% and 7.8%.

Twenty biological replicates of seeds from fad2-1a fad2-1b plants were found to have linolenic acid levels of 4.8%, 4.9%, 4.9%, 4.9%, 4.8%, 4.8%, 4.9%, 4.8%, 4.7%, 4.7%, 4.8%, 4.8%, 4.7%, 4.7%, 4.7%, 4.7%, 4.6%, 4.6%, 4.6% and 4.6%; linoleic acid levels of 3.7%, 4.4%, 4.5%, 4.7%, 5.6%, 5.3%, 5.9%, 6.4%, 4.1%, 4.8%, 4.9%, 4.4%, 5.7%, 5.7%, 5.5%, 5.3%, 4.9%, 5.0%, 5.3% and 5.3%; oleic acid levels of 79.4%, 78.2%, 77.8%, 77.8%, 76.7%, 77.0%, 76.4%, 76.5%, 78.6%, 78.3%, 78.0%, 78.6%, 76.9%, 77.2%, 77.4%, 77.1%, 77.5%, 77.4%, 77.1% and 77.1%; stearic acid levels of 3.4%, 3.3%, 3.3%, 3.3%, 3.3%, 3.3%, 3.3%, 3.2%, 3.3%, 3.3%, 3.4%, 3.4%, 3.3%, 3.3%, 3.3%, 3.3%, 3.5%, 3.5%, 3.5% and 3.5%; and palmitic acid levels of 7.5%, 8.0%, 8.3%, 8.1%, 8.4%, 8.3%, 8.4%, 8.0%, 8.0%, 7.6%, 7.8%, 7.6%, 8.2%, 8.0%, 8.0%, 8.5%, 8.2%, 8.2%, 8.3% and 8.3%.

Example 8—Generation of Transgene-Free Mutant Soybean Lines

To obtain soybean lines that have the FAD3 mutations but lack the FAD3 TAL effector endonuclease construct and its associated selectable marker, progeny are screened for the aabbcc genotype. Mutant, transgene-free segregants are then sought using a PCR strategy that utilized two sets of primer pairs: one spanning the TAL effector endonuclease coding sequence and the other the endogenous alcohol dehydrogenase gene of soybean (a control for the PCR reaction). These results indicate the feasibility of creating transgene-free lines with mutations in the FAD3A, FAD3B, and FAD3C genes.

Further, T1 plants containing FAD3A mutations within the FAD2 KO background were assessed by PCR for the presence of transgene sequence (TABLE 7). Of the 17 T1 plants assayed, 15 were positive for transgene sequence and two were negative (i.e., null segregants for the TAL effector endonuclease transgene). Importantly, the two transgene-free T1 plants harbored mutations within FAD3A. These two plants were self-pollinated to produce homozygous-mutant, transgene-free fad2-1a fad2-1b fad3a soybean plants.

Example 9—Generating Soybean Lines with Mutations in FAD2-1A and FAD2-1B Genes

To completely inactivate or knock out the alleles of FAD2-1A and FAD2-1B genes in soybean, sequence-specific nucleases were designed that target the protein coding region in the vicinity of the start codon. Eight TAL effector endonuclease pairs were designed to target the FAD2-1 gene family within the first 500 bp of the coding sequence using software that specifically identifies TAL effector endonuclease recognition sites, such as TALE-NT 2.0 (Doyle et al., Nucleic Acids Res 40:W117-122, 2012). The TAL effector endonuclease recognition sites for the FAD2-1 genes are listed in FIG. 10. TAL effector endonucleases were synthesized using methods similar to those described elsewhere (Cermak et al., Nucleic Acids Res 39:e82, 2011; Reyon et al., Nat Biotechnol 30:460-465, 2012; and Zhang et al., Nat Biotechnol 29:149-153, 2011). TALEN activity was verified using a yeast assay, and TALEN pair FAD2_T04 was chosen for stable transformation in soybean plants.

Candidate transgenic plants were regenerated and transferred to soil. After approximately 4 weeks of growth, a small leaf was harvested from each plant for DNA extraction and genotyping. Each DNA sample was first screened using PCR for the presence of transgenic DNA. All transgene-positive plants were then subjected to a T7E1 assay to identify plants with mutations at the FAD2-1A and FAD2-1B TAL effector endonuclease recognition site (Kim et al., Genome Res. 19:1279-1288, 2009). Briefly, a PCR product spanning the TAL effector endonuclease recognition site was generated, denatured, and allowed to reanneal. T7E1 endonuclease was added to the annealed products to cleave heteroduplexes generated when a wild type DNA fragment annealed with a fragment carrying a TAL effector endonuclease-induced mutation, and cleavage products were visualized by agarose gel electrophoresis. Four plants showed evidence of TAL effector endonuclease-induced mutations (Gm026-18, Gm026-23, Gm027-06 and Gm027-07). In addition, all four plants had mutations at both FAD2-1A and FAD2-1B, indicating that both genes were mutagenized simultaneously.

To determine if mutations introduced by TAL effector endonucleases in leaf tissue were transmitted to the next generation, seeds were collected from T0 plants Gm026-18, Gm026-23 and Gm027-06. In each T1 population, 20-60 individual plants were genotyped to confirm transmission of the mutations. Both FAD2-1A and FAD2-1B mutations segregated in the T1 progeny of GM026-18. In contrast, only FAD2-1A or FAD2-1B mutations were transmitted to the T1 progeny of GM-026-23 and GM027-6, respectively. The heritable mutations within GM026-18 are shown in FIG. 8.

Example 10—Phenotype of Soybean GM026-18 Lines

Seed from field-grown GM026-18 soybean plants was evaluated for protein content and fatty acid composition (FIG. 11). GM026-18 soybean plants were directly compared to control plants, Glycine max (L.) Merr. cultivar Bert, which do not contain FAD2-1A or FAD2-1B mutations. Twenty-seven different properties were evaluated, including moisture content (by forced draft oven evaluation), as well as protein, crude fat, tryptophan, cysteine, methionine, alanine, arginine, aspartic acid, glutamic acid, glycine, histidine, isoleucine, leucine, phenylalanine, proline, serine, threonine, total lysine, tyrosine, valine, palmitic acid, stearic acid, oleic acid, linoleic acid, alpha linolenic acid, and total fatty acid content. Unexpectedly, an increase in protein content was observed in GM026-18 lines compared to the wild type control (compare 37.93 to 34.49; compare 40.8 to 39.11; compare 38.4 to 37.6).

Example 11—Combinations of FAD2 and FAD3 Mutations

Plants containing combinations of mutations that knock out activity of one or more FAD2 and FAD3 genes or proteins are produced, either by targeting one gene or multiple genes using TAL effector endonucleases, or by crossing plants with mutations in different FAD2 and/or FAD3 genes. Plants containing a series of mutation combinations are produced. For example, combination 1 is FAD2-1A (WT)FAD2-1B (WT)fad3a (mutant) FAD3B (WT) FAD3C (WT). This combination of mutations and WT genes is also written as FAD2-1A FAD2-1B fad3a FAD3B FAD3C. Combination 1 and other combinations are set forth in TABLE 8.

Example 12—Field Trial Data from Plants Containing FAD2 and FAD3 Mutations

Plants having mutations in FAD2 and FAD3 genes were grown in field conditions in Minnesota, and phenotyped. Tested plants contained the genotype fad2-1a fad2-1b fad3a FAD3B FAD3C. Several plants having different mutations in FAD3A were tested, including those with a −43 bp deletion, a −4 bp deletion, and a combination of the −43 bp and −4 bp deletions (i.e., a compound heterozygous mutant). Seed oil produced by the field-grown plants was assessed by FAME. Results from the FAME testing are shown in FIG. 12.

TABLE 1

TAL effector endonuclease target sequences in FAD3 genes

| Gene | Target Sequence Left | SEQ ID NO: | Target Sequence Right | SEQ ID NO: |
|---|---|---|---|---|
| FAD3A_T01 | TCATTCTTCACATTGT | 6 | AGGAAGCTTTTCAGAC | 7 |
| FAD3A_T02 | CTAAATAGCCTGGTGT | 8 | ACTCAATTCTTGTGCC | 9 |

TABLE 1-continued

TAL effector endonuclease target sequences in FAD3 genes

| Gene | Target Sequence Left | SEQ ID NO: | Target Sequence Right | SEQ ID NO: |
|---|---|---|---|---|
| FAD3A_T03 | TTTGCAGGAGAATTAT | 10 | ACAAAATCATGGACAC | 11 |
| FAD3B_T01 | TCATTCTTCATTGATT | 12 | CATGGAAGCTTTTCAG | 13 |
| FAD3B_T02 | GAATAGCCTGGTGGGA | 14 | TCAATTCTTGTGCCAT | 15 |
| FAD3B_T03 | TTTGCAGGAGAATTAG | 16 | TCAAAACCATGGACAC | 17 |
| FAD3C_T01 | GGAACAGTGGTCATGG | 18 | TCCTTTGTTGAACAGC | 19 |
| FAD3C_T02 | GAACAGCATTGTGGGC | 20 | TCAATTCTTGTACCAT | 21 |
| FAD3C_T03 | TTACAACTCATGGATT | 22 | AGCCACAGGACTCACC | 23 |

TABLE 2

Representative FAD3A, FAD3B, and FAD3C coding sequences*

FAD3A

```
ATGGTTAAAGACACAAAGCCTTTAGCCTATGCTGCTAATAATGGATACCAA
AAGGAAGCTTTTGATCCCAGTGCTCCTCCACCGTTTAAGATTGCAGAAATC
AGAGTTGCAATACCAAAACATTGCTGGGTCAAGAATCCATGGAGATCCCTC
AGTTATGTTCTCAGGGATGTGCTTGTAATTGCTGCATTGATGGCTGCTGCAA
GTCACTTCAACAACTGGCTTCTCTGGCTAATCTATTGGCCCATTCAAGGAAC
AATGTTCTGGGCTCTGTTTGTTCTTGGACATGATTGgtaattaattaatttgttgttacttttttgtt
ataatatgaatctcacacactgattgttatgcctacctcatttcatttggattagacacattaaatttgagatattattatgttttttg
cttatatggtaaagtgattcattcttcacattgaattgaacagTGGCCATGGAAGCTTTTCAGACAGCC
CTTTTCTAAATAGCCTGGTGGGACACATCTTGCATTCCTCAATTCTTGTGCC
ATACCATGGATGgttagttcatcccggcttttttgtttgtcattggaagttcttttattgattcaattttttatagcgtgttcgg
aaacgcgtttcagaaaataatgaaatacatcttgaatctgaaagttataacttttagcttcattgtcattgaaagttcttttattaattat
atttttattgcgtgttttggaatcccatttgagaaataagaaatcacgtttaaaatgtgaaagttataactattaacttttgactaaactt
gaaaaaatcacattttttgatgtggaaccaaatctgatttgagaaccaagttgattttgatggattttgcagGAGAATTAG
CCACAGAACTCACCATCAAAATCATGGACACATTGAGAAGGATGAATCCT
GGGTTCCAgtatgtgattaactacttcctctatagttattttgattcaattaaatttatttatttaataagttcaagaaaaaagg
aatctttatacttcagataaagctgttcttgaacatttttttttgtcattatcttagTTAACCGAGAAGATTACAA
GAATCTAGACAACATGACAAGACTTGTTAGATTCACTGTGCCATTTCCATT
GTTTGTGTATCCAATTTATTTGgtgagtgcttttttttttttacttggaagactacaacacattattattattataa
tatggttcaaatcaatgactttttaatttcttttgtgatgtgcactccattttcagTTCTCAAGAAGCCCCGGAAAG
GAAGGTTCTCACTTCAATCCCTACAGCAATCTGTTCCCACCCAGTGAGAGA
AAGGGAATAGCAATATCAACACTGTGTTGGGTTACCATGTTTTCTATGCTT
ATCTATCTCTCCTTCATAACTAGTCCAGTTCTATTGCTCAAGCTCTATGAA
TTCCATATTGGtaattaaaattactcttacattacttttttcctctttttttttttatgggtcttaactagtatcacaaaaatattggt
taaaaaattttaaaaaaatatttattatgtaaatcataaaaagaacataaaaaaaatgatgaataacataattttcgtctcttattaaaa
atattttttattttaaatttcttaatcaatatatttagaatctggttaacatttttttgaatatttcaattctccaattaaaaatttgaaatagtca
ccattaattatgtaattgtttgaacacgtgcagATATTTGTTATGTGGCTGGACTTTGTCACATAC
TTGCATCACCATGGTCATCATCAGAAACTGCCTTGGTATCGCGGCAAGgtaac
aaaaataaatagaaaatagtgagtgaacacttaaatgttagatactaacttcttcttcttttttttttttttgaggttaatgctagataa
tagctagaaagagaaagaaagacaaatataggtaaaaataaataatataaccctgggaagaagaaaacataaaaaaagaaat
aatagagtctacgtaatgtttggattttgagtgaaatggtgttcacctaccattactcaaagattctgttgtctacgtagtgtttgga
ctttggagtgaaatggtgttcacctaccattactcagattctgttgtgtcccttagttactgtcttatattcttagggtatattctttatttt
acatccttttcacatcttacttgaaaagattttttaattattcattgaaatattaacgtgacagttaaattaaaataataaaaaaattcgtta
aaacttcaaatataagagtgaaaggatcatcattttttcttctttcttttattgcgttattaatcatgcttctcttcttttttttcttcgcttt
ccacccatatcaaattcatgtgaagtatgagaaaatcacgattcaatggaaagctacaggaactttttttgttttgtttttataatcg
gaattaatttatactccattttttcacaataaatgttacttagtgccttaaagataaatatttgaaaaattaaaaaaattattaatacactg
tactactatataatatttgacatatatttaacatgattttctattgaaaatttgtatttattattttttttaatcaaaaccataaggcattaatt
tacaagacccattttttcatttatagctttacctgtgatcatttatagcttttaagggacttagatgttacaatcttaattacaagtaaatat
ttatgaaaaacatgtgtcttaccccttaaccttacctcaacaaagaaagtgtgataagtggcaacacacgtgttgcttttttggcc
cagcaataacacgtgtttttgtggtgtacaaaaatggacagGAATGGAGTTATTAAGAGGTGGTCT
CACAACTGTGGATCGTGACTATGGTTGGATCAATAACATTCACCATGACAT
TGGCACCCATGTTATTCACCATCTTTTCCCTCAAATTCCTCATTATCACCTC
GTTGAAGCGgtatattttactattattactcacctaaaaagaatgcaattagtacatttgttttatctcttggaagttagtcatt
ttcagttgcatgattgtaatgttctctctatttttaaaccatgttttcacacctacttcgtttaaaataagaatgtggatactattctaatt
tctattaacttcttttaaaaaatatgtaaaactagtattaaaaaagaggaaatagattacactctactaatactaatagtataaaa
aaattacattgttattttatcacaaataattatataaatttttttacaatcattatcttaaaagtcatgtatgatatacagtttttacat
gctttggtacttattgtaaagttagtgattattcattatttatgttatataattggcataaatatcatgtaaccagctcactatactataa
tgggaacttggtggtgaaagggggtttacaaccctcttttctaggtgtaggtgctttgatacttctggtcccttttatatcaatataaa
ttatattttgctgataaaaaaaacattattaatatataatcattaacttcttttaaaaaccgtacctaaaactttatattattaaaagaag
attgagatcagcaaaagaaaaaaaataacagtcatttgaattcactgcagACACAAGCAGCAAAATCAG
TTCTTGGAGAGTATTACCGTGAGCCAGAAAGATCTGCACCATTACCATTTC
ATCTAATAAAGTATTTAATTCAGAGTATGAGACAAGACCACTTCGTAAGTG
ACACTGGAGATGTGGTTTATTATCAGACTGATTCTCTGCACCTTCACTCGCA
CCGAGACTGA (SEQ ID NO: 24)
```

TABLE 2-continued

Representative FAD3A, FAD3B, and FAD3C coding sequences*

FAD3B

ATGGTTAAAGACACAAAGCCTTTAGCCTATGCTGCCAATAATGGATACCAA
CAAAAGGGTTCTTCTTTTGATTTTGATCCTAGCGCTCCTCCACCGTTTAAGA
TTGCAGAAATCAGAGCTTCAATACCAAACATTGCTGGGTCAAGAATCCAT
GGAGATCCCTCAGTTATGTTCTCAGGGATGTGCTTGTAATTGCTGCATTGGT
GGCTGCAGCAATTCACTTCGACAACTGGCTTCTCTGGCTAATCTATTGCCCC
ATTCAAGGCACAATGTTCTGGGCTCTCTTTGTTCTTGGACATGATTGgtaataatt
tttgtgtttatactcttttttttttttttttgtttatgatatgaatctcacacattgttctgttatgtcatttcttcttcatttggctttagacaac
ttaaatttgagatctttattatgttttttgatatatggtaaagtgattcttcattatttcattcttcattgattgaattgaacagTGGCC
ATGGAAGCTTTTCAGATAGCCCTTTGCTGAATAGCCTGGTGGGACACATCT
TGCATTCCTCAATTCTTGTGCCATACCATGGATGgttagttcatactggcttttttgtttgttcattt
gtcattgaaaaaaaatcttttgttgattcaattatttttatagtgtgtttggaagcccgtttgagaaaataagaaatcgcatctggaat
gtgaaagttataactatttagatcatctgtcgttgcaagttatttattggttaaattttttatagcgtgctaggaaacccattcgaga
aaataagaaatcacatctggaatgtgaaagttataactgttagcttctgagtaaacgtggaaaaaccacattttggatttggaac
caaattttatttgataaatgacaaccaaattgatttttgatggattttttgcagGAGAATTAGCCACAGAACTCAC
CATCAAAACCATGGACACATTGAGAAGGATGAGTCATGGGTTCCAgtatgtgatt
aattgcttctcctatagttgttcttgattcaattacattttatttatttggtaggtccaagaaaaaagggaatctttatgcttcctgagg
ctgttcttgaacatggctcttttttatgtgtcattatcttagTTAACAGAGAAGATTTACAAGAATCTAG
ACAGCATGACAAGACTCATTAGATTCACTGTGCCATTTCCATTGTTTGTGTA
TCCAATTTATTTGgtgagtgattttttgacttggaagacaacaacacattattattataatatggttcaaaacaatgact
ttttctttatgatgtgaactccattttttagTTTTCAAGAAGCCCCGGAAAGGAAGGCTCTCACTT
CAATCCCTACAGCAATCTGTTTCCACCCAGTGAGAGAAAAGGAATAGCAAT
ATCAACACTGTGTTGGGCTACCATGTTTTCTCTGCTTATCTATCTCTCATTCA
TAACTAGTCCACTTCTAGTGCTCAAGCTCTATGGAATTCCATATTGGgtaactaa
attactcctacattgttacttttcctccttttttttattatttcaattctccaattggaaatttgaaatagttaccataattatgtaattgttt
gatcatgtgcagATATTTGTTATGTGGCTGGACTTTGTCACATACTTGCATCACCAT
GGTCACCACCAGAAACTGCCTTGGTACCGCGGCAAGgtaacaaaaataaatagaaaatag
tgggtgaacacttaaatgcgagatagtaatacctaaaaaaagaaaaaaatataggtataataaataataactttcaaaataaa
aagaaatcatagagtctagcgtagtgtttggagtgaaatgatgttcacctaccattactcaaagatttttgttgtgtccatagttcat
tatattattttacatatcttacttgaaaagacttttttaattattcattgagatctttaaagtgactgttaaattaaaataaaaaacaagttt
gttaaaacttcaaataaataagagtgaaggagtgtgtcatttgtatattattttgcgttattaatcacgtttctcttctctttttttttt
tttcttctctgctttccacccattatcaagttcatgtgaagcagtggcggatctatgtaaatgagtgggggggcaattgcacccaca
agatttttattttttatttgtacaggaataataaaataaaacttgccccataaaaaataaatatttttttcttaaaataatgcaaaataa
atataagaaataaaaagagaataaattattattaattttattattttgtacttttttatttagttttttttagcggttagattttttttcatgacat
tatgtaatcttttaaaagcatgtaatattttttatttttgtgaaaataaatataaatgatcatattagtctcagaatgtataaactaataata
attttatcactaaaagaaattctaatttagtccataaataagtaaaacaagtgacaattatattttatatttacttaatgtgaaataata
cttgaacattataataaaacttaatgacaggagatattacatagtgccataaagatattttaaaaaataaaatcattaatacactgt
actactatataataattcgatatatattttttaacatgattctcaatagaaaaattgtattgattatattttattagacatgaatttacaagcc
ccgtttttcatttatagctcttacctgtgatctattgttttgcttcgctgtttttgttggtcaagggacttagatgtcacaatattaatact
agaagtaaatatttatgaaaacatgtaccttacctccaacaaagaaagtgtggtaagtggcaacacacgtgttgcatttttggccc
agcaataacacgtgtttttgtggtgtactaaaatggacagGAATGGAGTTATTTAAGAGGTGGCCTC
ACCACTGTGGATCGTGACTATGGTTGGATCAATAACATTCACCATGACATT
GGCACCCATGTTATCCACCATCTTTTCCCCCAAATTCCTCATTATCACCTCG
TTGAAGCGgtacattttattgcttattcacctaaaaacaatacaattagtcatttgtttatctcttggaagttagtcattttca
gttgcatgattctaatgctctctccattcttaaatcatgttttcacacccacttcatttaaaataagaacgtgggtgttattttaatttct
attcactaacatgagaaattaacttatttcaagtaataattttaaaatatttttatgctattattttattacaaataattatgtatattaagtt
tattgatttttataattatattaaaattatatcgatattaatttttcactgatagtgttttatattgttagtactgtgcatttattttaa
aattggcataaataatatatgtaaccagctcactatactatactgggagcttggtggtgaaaggggttcccaaccctccttttctag
gtgtacatgattgatacttctggtaccttatatatcaatataaattatattttgctgataaaaaaacatggttaaccattaaattctttt
tttaaaaaaaaaaactgtatctaaactttgtattattaaaaagaagtctgagattaacaataaactaacactcatttgaattcactgca
gACACAAGCAGCAAAACCAGTTCTTGGAGATTACTACCGTGAGCCAGAAAG
ATCTGCGCCATTACCATTTCATCTAATAAAGTATTTAATTCAGAGTATGAGA
CAAGACCACTTCGTAAGTGACACTGGAGATGTTGTTTATTATCAGACTGAT
TCTCTGCTCCTCCACTCGCAACGAGACTGA (SEQ ID NO: 25)

FAD3C

ATGGTTCAAGCACAGCCTCTACAACATGTTGGTAATGGTGCAGGGAAAGA
AGATCAAGCTTATTTTGATCCAAGTGCTCCACCACCCTTCAAGATTGCAAA
TATCAGAGCAGCAATTCCAAAACATTGCTGGGAGAAGAACACATTGAGAT
CTCTGAGTTATGTTCTGAGGGATGTGTTGGTAGTGACTGCATTGGTAGCTGC
AGCAATCGGCTTCAATAGCTGGTTCTTCTGGCCACTCTATTGGCCTGCACAA
GGCACAATGTTTTGGGCACTTTTTGTTCTTGGACATGATTGgtaactaattattattacaa
attgttatgttatgttgttgtgtgcattttctcagtgatgattagtcatttcatttcacttggttatgcatgattgttcgttcat
atgttctgtcatggtgagttctaatttgattgatgcatggaacagTGGTCATGGAAGTTTTTCAAACAGT
CCTTTGTTGAACAGCATTGTGGGCCACATCTTGCACTCTTCAATTCTTGTAC
CATACCATGGATGgtcggttcctttttagcaacttttcatgttcacttttgtccttaaatttttttttttatgtttgttaaaaaatcttt
tggtctgatttaacaaccttaaccatttttacaactcatggattttttgcagGAGAATTAGCCACAGGACTCAC
CATCAGAACCATGGCCATGTTGAGAAGGATGAATCATGGGTTCCGgtattactatg
agtttgatgattaatttccacattttttctttcttcttaattttaatcagtggttagatttggttgtgttccaatagaagaaaaggggggta
tctagagagatgtgaatttcatgaagtggttcatgattatgtgtctttatgcctttatgtcagCTTACAGAGAAAGTT
TACAAGAATCTAGACAACATGACAAGAATGATGAGATTCACTCTTCCTTTC
CCCATCTTTGCATACCCCTTTTATTTGgtgagaccctcttttttccagaatgacagcattatttttactatat
agtacctcaattttttatatttctaaaattttttgaattcttgaaattgaaaggaaaggactttattgggtctagcatctcactctctcttgt
gatatgaaccatatatttcagTGGAGCAGAAGCCCTGGAAAAGAAGGCTCTCATTTCAA
CCCTTACAGCAACTTGTTCTCTCCTGGTGAGAGAAGAGATGCTAACTTC
AACTCTGTGTTGGGGCATCATGCTTTCTGTGCTTCTCTATCTTTCCCTCACA TABLE 2-continued Representative FAD3A, FAD3B, and FAD3C coding sequences*

ATGGGTCCACTTTTTATGCTCAAGCTCTATGGGGTTCCCTATTTGgtaatctcactct
cacactttctttatacatcgcacaccagtgtgggttatttgcaacctacaccgaagtaatgccctataattaatggggttaacaca
tgtccaagtccaatattttgttcacttatttgaacttgaacatgtgtagATCTTCGTCATGTGGCTGGATTTC
GTCACGTACTTGCATCATCATGGTTACAAGCAGAAACTGCCTTGGTACCGT
GGCCAGgtatcccatttaacacaatttgtttcattaacattttaagagaattttttttttcaaatagttttcgaaattaagcaaata
ccaagcaaattgttagatctacgcttgtacttgttttaaagtcaaattcatgaccaaattgtcctcacaagtccaaaccgtccacta
tttttattttcacctactttatagcccaatttgtcatttggttacttcagaaaagagaaccccatttgtagtaaatatattatttatgaatta
tggtagtttcaacataaaacatatttatgtgcagttttgccatccttcaaaagaagatagaaaacttactccatgttactctgtctatat
gtaatttcacagGAATGGAGTTATCTAAGGGGTGGTCTTACAACAGTAGATCGCGA
CTATGGTTGGATCAACAACATTCACCATGACATTGGCACCCATGTTATCCA
TCACCTTTTCCCTCAAATTCCACATTATCATTTAATCGAAGCGgtattaattctctatttc
acaagaaattattgtatgtctgcctatgtgatctaagtcaattttcacataacacatgatcaaacttcttaattctcttcttctaaattga
aaaagtggattatatgtcaattgaaaattggtcaagaccacaaacatgtgatgatctcccaccttacatataataatttctcctattc
tacaatcaataatccttctatggtcctgaattgttcattattttttcattttcttattcttttttgttgtcccacaatagACTAAAGC
AGCAAAGGCAGTGCTAGGAAAGTATTATCGTGAGCCTCAGAAACTGGGC
CATTGCCACTTCATCTAATAAAGTACTTGCTCCACAGCATAAGTCAGGATC
ACTTCGTTAGCGACTCTGGCGACATTGTGTACTACCAGACTGATTCCCAGCT
CCACAAAGATTCTTGGACCCAGTCCAACTAA (SEQ ID NO: 26)

*intron sequences are in lower case

TABLE 3

TAL effector endonuclease target sequences in FAD2 genes

| Gene | Target Sequence Left | SEQ ID NO: | Target Sequence Right | SEQ ID NO: |
|---|---|---|---|---|
| FAD2_T01_C11 | GCCACCACCTACTTCCACC TCCT | 27 | ATTGCATGGCCAATCT | 28 |
| FAD2_T01_C40 | GCCACCACCTACTTCCACC TCCT | 29 | ATTGCATGGCCAATCT | 30 |
| FAD2_T02_C11 | ACATTGCCACCACCTACTT CCACCT | 31 | ATTGCATGGCCAATCT | 32 |
| FAD2_T02_C40 | ACATTGCCACCACCTACTT CCACCT | 33 | ATTGCATGGCCAATCT | 34 |
| FAD2_T03_C11 | CTCATGGAAAATAAGCCAT | 35 | ACCGTGATGAAGTGTTTGT CCC | 36 |
| FAD2_T03_C40 | CTCATGGAAAATAAGCCAT | 37 | ACCGTGATGAAGTGTTTGT CCC | 38 |
| FAD2_T04_C11 | ATTTCTCATGGAAAATAAG CCAT | 39 | ACCGTGATGAAGTGTTTGT CCC | 40 |
| FAD2_T04_C40 | ATTTCTCATGGAAAATAAG CCAT | 41 | ACCGTGATGAAGTGTTTGT CCC | 42 |

TABLE 4

Representative FAD2-1A and FAD2-1B coding sequences*

FAD2-1A

ATGgtcatgatttcactactctaatctaccattcattttgtagttgtcat
tatattagattttttcactacctggtttaaaattgagggattgtagttctg
ttggtacatattacacattcagcaaaacaactgaaactcaactgaacttg
atatactttgacacagGGTCTAGCAAAGGAAACAACAATGGGAGGTAGAG
GTCGTGTGGCCAAAGTGGAAGTTCAAGGGAAGAAGCCTCTCTCAAGGGTT
CCAAACACAAAGCCACCATTCACTGTTGGCCAACTCAAGAAAGCAATTCC
ACCACACTGCTTTCAGCGCTCCCTCCTCACTTCATTCTCCTATGTTGTTT
ATGACCTTTCATTTGCCTTCATTTTCTACATTGCCACCACCTACTTCCAC
CTCCTTCCTCAACCCTTTCCCTCATTGCATGGCCAATCTTCACGAGTTGGTC
CCAAGGTTGCCTTCTCACTGGTTGCTGTGGGTGATTGCTCACGAGTGGTC
ACCATGCCTTCAGCAAGTACCAATGGGTTGATGATGTTGTGGGTTTGACC
CTTCACTCAACACTTTTAGTCCCTTATTTCTCATGGAAAATAAGCCATCG
CCGCCATCACTCCAACACAGGTTCCCTTGACCGTGATGAAGTGTTTGTCC
CAAAACCAAAATCCAAAGTTGCATGGTTTTCCAAGTACTTAAACAACCCT
CTAGGAAGGGCTGTTTCTCTTCTCGTCACACTCACAATAGGGTGGCCTAT
GTATTTAGCCTTCAATGTCTCTGGTAGACCCTATGATAGTTTTGCAAGCC
ACTACCACCCTTATGCTCCCATATATTCTAACCGTGAGAGGCTTCTGATC
TATGTCTCTGATGTTGCTTTGTTTTCTGTGACTTACTCTCTCTACCGTGT
TGCAACCCTGAAAGGGTTGGTTTGGCTGCTATGTGTTTATGGGGTGCCTT
TGCTCATTGTGAACGGTTTTCTTGTGACTATCACATATTTGCAGCACACA
CACTTTGCCTTGCCTCATTACGATTCATCAGAATGGGACTGGCTGAAGGG
AGCTTTGGCAACTATGGACAGAGATTATGGGATTCTGAACAAGGTGTTTC
ATCACATAACTGATACTCATGTGGCTCACCATCTCTTCTCTACAATGCCA
CATTACCATGCAATGGAGGCAACCAATGCAATCAAGCCAATATTGGGTGA
GTACTACCAATTTGATGACACACCATTTTACAAGGCACTGTGGAGAGAAG
CGAGAGAGTGCCTCTATGTGGAGCCAGATGAAGGAACATCCGAGAAGGGC
GTGTATTGGTACAGGAACAAGTATTGA (SEQ ID NO: 43)

FAD2-1B

ATGgtcatgatttcactactctaatctgtcacttccaccattcattttgt
acttctcatattttttcacttcctggttgaaaattgtagttctcttggtac TABLE 4-continued Representative FAD2-1A and FAD2-1B coding sequences*

```
atactagtattagacattcagcaacaacaactgaactgaacttattatac
tttgacacagGGTCTAGCAAAGGAAACAATAATGGGAGGTGGAGGCCGTG
TGGCCAAAGTTGAAATTCAGCAGAAGAAGCCTCTCTCAAGGGTTCCAAAC
ACAAAGCCACCATTCACTGTTGGCCAACTCAAGAAAGCCATTCCACCGCA
CTGCTTTCAGCGTTCCCTCCTCACTTCATTGTCCTATGTTGTTTATGACC
TTTCATTGGCTTTCATTTTCTACATTGCCACCACCTACTTCCACCTCCTC
CCTCACCCCTTTTCCCTCATTGCATGGCCAATCTATTGGGTTCTCCAAGG
TTGCATTCTTACTGGCGTGTGGGTGATTGCTCACGAGTGTGGTCACCATG
CCTTCAGCAAGTACCCATGGGTTGATGATGTTATGGGTTTGACCGTTCAC
TCAGCACTTTTAGTCCCTTATTTCTCATGGAAAATAAGCCATCGCCGCCA
CCACTCCAACACGGGTTCCCTTGACCGTGATGAAGTGTTTGTCCCAAAAC
CAAAATCCAAAGTTGCATGGTACACCAAGTACCTGAACAACCCTCTAGGA
AGGGCTGCTTCTCTTCTCATCACACTCACAATAGGGTGGCCTTTGTATTT
AGCCTTCAATGTCTCTGGCAGACCCTATGATGGTTTTGCTAGCCACTACC
ACCCTTATGCTCCCATATATTCAAATCGTGAGAGGCTTTTGATCTATGTC
TCTGATGTTGCTTTGTTTTCTGTGACTTACTTGCTCTACCGTGTTGCAAC
TATGAAAGGGTTGGTTTGGCTGCTATGTGTTTATGGGGTGCCATTGCTCA
TTGTGAACGGTTTTCTTGTGACCATCACATATCTGCAGCACACACACTAT
GCCTTGCCTCACTATGATTCATCAGAATGGGATTGGCTGAGGGGTGCTTT
GGCAACTATGGACAGAGATTATGGAATTCTGAACAAGGTGTTTCACCACA
TAACTGATACTCATGTGGCTCACCATCTTTTCTCTACAATGCCACATTAC
CATGCAACGGAGGCAACCAATGCAATGAAGCAATATTGGGTGAGTACTA
CCGATTTGATGACACACCATTTTACAAGGCACTGTGGAGAGAAGCAAGAG
AGTGCCTCTATGTGGAGCCAGATGAAGGAACATCCGAGAAGGGCGTGTA
TGGTACAGGAACAAGTATTGA (SEQ ID NO: 44)
```

*intron sequences are in lower case

TABLE 5

454 Pyro-sequencing Data for FAD3A TAL effector endonuclease

| TAL effector endonuclease name | Location of target site | NHEJ mutagenesis frequency** |
|---|---|---|
| GmFAD3A_T01 | FAD3A | 10.15 (10172) |
| GmFAD3A_T01 | FAD3B | 1.48 (15658) |
| GmFAD3A_T01 | FAD3C | 0.04 (11763) |
| GmFAD3A_T02 | FAD3A | 14.48 (12043) |
| GmFAD3A_T02 | FAD3B | 8.81 (10573) |
| GmFAD3A_T02 | FAD3C | 0.01 (14629) |
| GmFAD3A_T03 | FAD3A | 4.4 (12692) |
| GmFAD3A_T03 | FAD3B | 2.39 (11614) |
| GmFAD3A_T03 | FAD3C | 0.17 (10163) |

**The total number of 454 sequencing reads used for this analysis is indicated in parentheses.

TABLE 6

Confirmed genotyping of FAD3 T0 mutant plants

| Plant name | Background | FAD3A T7 result | FAD3A Mutant Alleles (SEQ ID NO:) | FAD3A WT Allele | FAD3B T7 result | FAD3B Mutant Alleles (SEQ ID NO:) | FAD3B WT Allele |
|---|---|---|---|---|---|---|---|
| Gm183-1 | FAD2 KO | pos | 1 unique (64) | Yes | pos | 1 unique (91) | Yes |
| Gm183-2 | FAD2 KO | pos | 2 unique (65, 66) | Yes | pos | 1 unique (92) | Yes |
| Gm183-4 | FAD2 KO | pos | 1 unique (67) | Yes | neg | | |
| Gm183-5 | FAD2 KO | pos | 1 unique (68) | Yes | neg | | |
| Gm183-6 | FAD2 KO | pos | 6 unique (69-74) | No | pos | 2 unique (93, 94) | Yes |
| Gm183-7 | FAD2 KO | pos | 2 unique (75, 76) | Yes | neg | | |
| Gm183-8 | FAD2 KO | pos | 3 unique (77-79) | Yes | pos | 2 unique (95, 96) | Yes |
| Gm184-1 | WT | pos | 1 unique (80) | No | neg | | |
| Gm184-2 | WT | pos | 2 unique (81, 82) | No | neg | | |
| Gm184-4 | WT | pos | 2 unique (83, 84) | Yes | neg | | |
| Gm184-5 | WT | pos | 2 unique (85, 86) | Yes | pos | | Yes |
| Gm205-1 | FAD2 KO | pos | 1 unique (87) | Yes | pos | 2 unique (97, 98) | Yes |
| Gm205-2 | FAD2 KO | pos | 1 unique (88) | Yes | pos | 1 unique (99) | Yes |
| Gm206-1 | WT | pos | 2 unique (89, 90) | Yes | neg | | |

The FAD2 KO background included the Gm026-18 FAD2-1A (SEQ ID NO:100) and FAD2-1B alleles (SEQ ID NO:101) alleles.

TABLE 7

Confirmed genotyping of T1 plants from T0 plants containing FAD2 and FAD3 mutations

| Parent Line (T0) | Background | T1 Plant Number | FAD3A genotype | Mutant Allele SEQ ID NO: | Presence of Transgene |
|---|---|---|---|---|---|
| Gm183-4 | FAD2 KO | 1 | −7 bp/WT | 102 | Undetected |
| | FAD2 KO | 2 | −7 bp/−7 bp | 102 | + |
| | FAD2 KO | 3 | −7 bp/−7 bp | 102 | + |
| | FAD2 KO | 4 | −7 bp/WT | 102 | + |
| Gm183-5 | FAD2 KO | 2 | −43 bp/WT | 104 | + |
| | FAD2 KO | 4 | −43 bp/−43 bp | 104 | + |
| | FAD2 KO | 5 | −43 bp/−43 bp | 104 | Undetected |
| | FAD2 KO | 7 | −43 bp/−43 bp | 104 | + |
| | FAD2 KO | 8 | −4 bp/−4 bp | 103 | + |
| | FAD2 KO | 9 | −43 bp/−43 bp | 104 | + |

TABLE 7-continued

Confirmed genotyping of T1 plants from
T0 plants containing FAD2 and FAD3 mutations

| Parent Line (T0) | Background | T1 Plant Number | FAD3A genotype | Mutant Allele SEQ ID NO: | Presence of Transgene |
|---|---|---|---|---|---|
| Gm183-6 | FAD2 KO | 1 | −4 bp/−4 bp | 105 | + |
|  | FAD2 KO | 4 | −4 bp/WT | 105 | + |
|  | FAD2 KO | 5 | −4 bp/−4 bp | 105 | + |
|  | FAD2 KO | 7 | −4 bp/WT | 105 | + |
|  | FAD2 KO | 11 | −4 bp/WT | 105 | + |
|  | FAD2 KO | 12 | −4 bp/WT | 105 | + |
|  | FAD2 KO | 14 | −4 bp/WT | 105 | + |
| Gm184-3 | WT | 20 | −4 bp/−4 bp | 106 | + |

TABLE 8

Combinations of FAD2 and FAD3 mutations

| Combination | Designation |
|---|---|
| 1 | FAD2-1A FAD2-1B fad3a FAD3B FAD3C |
| 2 | FAD2-1A FAD2-1B FAD3A fad3b FAD3C |
| 3 | FAD2-1A FAD2-1B FAD3A FAD3B fad3c |
| 4 | FAD2-1A FAD2-1B fad3a fad3b FAD3C |
| 5 | FAD2-1A FAD2-1B fad3a FAD3B fad3c |
| 6 | FAD2-1A FAD2-1B fad3a fad3b fad3c |
| 7 | FAD2-1A FAD2-1B FAD3A fad3b fad3c |
| 8 | fad2-1a fad2-1b fad3a FAD3B FAD3C |
| 9 | fad2-1a fad2-1b FAD3A fad3b FAD3C |
| 10 | fad2-1a fad2-1b FAD3A FAD3B fad3c |
| 11 | fad2-1a fad2-1b fad3a fad3b FAD3C |
| 12 | fad2-1a fad2-1b fad3a FAD3B fad3c |
| 13 | fad2-1a fad2-1b fad3a fad3b fad3c |
| 14 | fad2-1a fad2-1b FAD3A fad3b fad3c |

OTHER EMBODIMENTS

It is to be understood that while the invention has been described in conjunction with the detailed description thereof, the foregoing description is intended to illustrate and not limit the scope of the invention, which is defined by the scope of the appended claims. Other aspects, advantages, and modifications are within the scope of the following claims.

SEQUENCE LISTING (4908 sequences)

SEQ ID NO: 1 - DNA, 941 bp, Glycine Max
  FAD3A
atggttaaagacacaaagcctttagcctatgctgctaataatggataccaaaaggaagcttttgatcccagtgctcctccaccgtttaagattgcagaaatcagagttgcaataccaaaacattgctgggtcaagaatccatggagatccctcagttatgttctcagggatgtgcttgtaattgctgcattgatggctgctgcaagtcacttcaacaactggcttctctggctaatctattggcccattcaaggaacaatgttctgggctctgtttgttcttggacatgattggtaattaattaatttgttgttacttttttgttataatatgaatctcacacactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttcca

SEQ ID NO: 2 - DNA, 1002 bp, Glycine Max
  FAD3B
atggttaaagacacaaagcctttagcctatgctgccaataatggataccaacaaaagggttcttcttttgattttgatcctagcgctcctccaccgtttaagattgcagaaatcagagcttcaataccaaaacattgctgggtcaagaatccatggagatccctcagttatgttctcagggatgtgcttgtaattgctgcattggtggctgcagcaattcacttcgacaactggcttctctggctaatctattgccccattcaaggcacaatgttctgggctctctttgttcttggacatgattggtaataatttttgtgtttcttactcttttttttttttttttgtttatgatatgaatctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaataagaaatcgcatctggaatgtgaaagttataactatttagcttcatctgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttcca

SEQ ID NO: 3 - DNA, 736 bp, Glycine Max
  FAD3C
atggttcaagcacagcctctacaacatgttggtaatggtgcagggaaagaagatcaagcttattttgatccaagtgctccaccacccttcaagattgcaaatatcagagcagcaattccaaaacattgctgggagaagaacacattgagatctctgagttatgttctgagggatgtgttggtagtgactgcattggtagctgcagcaatcggcttcaatagctggttcttctggccactctattggcctgcacaaggcacaatgttttgggcactttttgttcttggacatgattggtaactaattattattacaaattgttatgttatgttatgttatgttgttgtgcctttttctcagtgatgctttagtcatttcatttcacttggttatgcatgattgttcgttcatatgttctgtcatggtgagttctaatttgattgatgcatggaacagtggtcatggaagtttttcaaacagtcctttgttgaacagcattgtgggccacatcttgcactcttcaattcttgtaccataccatggatggtcggttccttttagcaacttttcatgttcactttgtccttaaatttttttttatgtttgttaaaaaatctttggtctgatttaacaacctaaccatttttacaactcatggattttttgcaggagaattagccacaggactcaccatcagaaccatggccatgttgagaaggatgaatcatgggttccg

SEQ ID NO: 4 - DNA, 1331 bp, Glycine Max
  FAD2-1A
atggtcatgatttcactctctctaatctctccattcattttgtagttgtcattatctttagatttttcactacctggtttaaaattgagggattgtagttctgttggtacatattacacattcagcaaaacaactgaaactcaactgaacttgtttatactttgacacagggtctagcaaaggaaacaacaatgggaggtagaggtcgtgtggccaaagtggaagttcaagggaagaagcctctctcaagggttccaaacacaaagccaccattcactgttggccaactcaagaaagcaattccaccacactgctttcagcgctccctcctcacttcattctcctatgttgtttatgacctttcatttgccttcattttctacattgccaccacctacttccacctccttcctcaacccttttccctcattgcatggccaatctattgggttctccaaggttgccttctcactggtgtgtgggtgattgctcacgagtgtggtcaccatgccttcagcaagtaccaatgggttgatgatgttgtgggtttgacccttcactcaacacttttagtcccttatttctcatggaaaataagccatcgccgccatcactccaacacaggttcccttgaccgtgatgaagtgtttgtcccaaaaccaaaatccaaagttgcatggttttccaagtacttaaacaaccctctaggaagggctgtttctcttctcgtcacactcacaatagggtggcctatgtatttagccttcaatgtctctggtagaccctatgatagttttgcaagccactaccacccttatgctcccatatattctaaccgtgagaggcttctgatctatgtctctgatgttgctttgttttctgtgacttactctctctaccgtgttgcaaccctgaaagggttggtttggctgctatgtgtttatggggtgcctttgctcattgtgaacggttttcttgtgactatcacatatttgcagcacacacactttgccttgcctcattacgattcatcagaatgggactggctgaagggagctttggcaactatggacagagattatgggattctgaacaaggtgtttcatcacataactgatactcatgtggctcaccatctcttctctacaatgccacattaccatgcaatggaggcaaccaatgcaatcaagccaatattgggtgagtactaccaatttgatgacacaccattttacaaggcactgtggagagaagcgagagagtgcctctatgtggagccagatgaaggaacatccgagaagggcgtgtattggtacaggaacaagtattga

SEQ ID NO: 5 - DNA, 1324 bp, Glycine Max
  FAD2-1B
atggtcatgatttcactctctctaatctgtcacttccctccattcattttgtacttctcatatttttcacttcctggttgaaaattgtagttctcttggtacatactagtattagacattcagcaacaacaactgaactgaacttctttatactttgacacagggtctagcaaaggaaacaataatgggaggtggaggccgtgtggccaaagttgaaattcagcagaagaagcctctctcaagggttccaaacacaaagccaccattcactgttggccaactcaagaaagccattccaccgcactgctttcagcgttccctcctcacttcattgtcctatgttgtttatgacctttcattggctttcattttctacattgccaccacctacttccacctcctccctcaccccttttccctcattgcatggccaatctattgggttctccaaggttgcattcttactggcgtgtgggtgattgctcacgagtgtggtcaccatgccttcagcaagtacccatgggttgatgatgttatgggtttgaccgttcactcagcacttttagtcccttatttctcatggaaaataagccatcgccgccaccactccaacacgggttcccttgaccgtgatgaagtgtttgtcccaaaaccaaaatccaaagttgcatggtacaccaagtacctgaacaaccctctaggaagggctgcttctcttctcatcacactcacaatagggtggcctttgtatttagccttcaatgtctctggcagaccctatgatggttttgctagccactaccacccttatgctcccatatattcaaatcgtgagaggcttttgatctatgtctctgatgttgctttgttttctgtgacttacttgctctaccgtgttgcaactatgaaagggttggtttggctgctatgtgtttatggggtgccattgctcattgtgaacggttttcttgtgaccatcacatatctgcagcacacacactatgccttgcctcactatgattcatcagaatgggattggctgaggggtgctttggcaactatggacagagattatggaattctgaacaaggtgtttcaccacataactgatactcatgtggctcaccatcttttctctacaatgccacattaccatgcaacggaggcaaccaatgcaatgaagccaatattgggtgagtactaccgatttgatgacacaccattttacaaggcactgtggagagaagcaagagagtgcctctatgtggagccagatgaaggaacatccgagaagggcgtgtattggtacaggaacaagtattga

SEQ ID NO: 6 - DNA, 16 bp, Glycine Max
  FAD3 TALEN target sequence
tcattcttcacattgt

SEQ ID NO: 7 - DNA, 16 bp, Glycine Max
  FAD3 TALEN target sequence
aggaagcttttcagac

SEQ ID NO: 8 - DNA, 16 bp, Glycine Max
  FAD3 TALEN target sequence
ctaaatagcctggtgt

SEQ ID NO: 9 - DNA, 16 bp, Glycine Max
  FAD3 TALEN target sequence
actcaattcttgtgcc

SEQ ID NO: 10 - DNA, 16 bp, Glycine Max
  FAD3 TALEN target sequence
tttgcaggagaattat

SEQ ID NO: 11 - DNA, 16 bp, Glycine Max
  FAD3 TALEN target sequence
acaaaatcatggacac

SEQ ID NO: 12 - DNA, 16 bp, Glycine Max
  FAD3 TALEN target sequence
tcattcttcattgatt

SEQ ID NO: 13 - DNA, 16 bp, Glycine Max
  FAD3 TALEN target sequence
catggaagcttttcag

SEQ ID NO: 14 - DNA, 16 bp, Glycine Max
  FAD3 TALEN target sequence
gaatagcctggtggga

SEQ ID NO: 15 - DNA, 16 bp, Glycine Max
  FAD3 TALEN target sequence
tcaattcttgtgccat

SEQ ID NO: 16 - DNA, 16 bp, Glycine Max
  FAD3 TALEN target sequence
tttgcaggagaattag

SEQ ID NO: 17 - DNA, 16 bp, Glycine Max
  FAD3 TALEN target sequence
tcaaaaccatggacac

SEQ ID NO: 18 - DNA, 16 bp, Glycine Max
  FAD3 TALEN target sequence
ggaacagtggtcatgg

SEQ ID NO: 19 - DNA, 16 bp, Glycine Max
  FAD3 TALEN target sequence
tcctttgttgaacagc

SEQ ID NO: 20 - DNA, 16 bp, Glycine Max
  FAD3 TALEN target sequence
gaacagcattgtgggc

SEQ ID NO: 21 - DNA, 16 bp, Glycine Max
  FAD3 TALEN target sequence
tcaattcttgtaccat

SEQ ID NO: 22 - DNA, 16 bp, Glycine Max
  FAD3 TALEN target sequence
ttacaactcatggatt

SEQ ID NO: 23 - DNA, 16 bp, Glycine Max
  FAD3 TALEN target sequence
agccacaggactcacc

SEQ ID NO: 24 - DNA, 3868 bp, Glycine Max
  FAD3A
atggttaaagacacaaagcctttagcctatgctgctaataatggataccaaaaggaagcttttgatcccagtgctcctccaccgtttaagattgcagaaatcagagttgcaataccaaaacattgctgggtcaagaatccatggagatccctcagttatgttctcagggatgtgcttgtaattgctgcattgatggctgctgcaagtcacttcaacaactggcttctctggctaatctattggcccattcaaggaacaatgttctgggctctgtttgttcttggacatgattggtaattaattaatttgttgttacttttttgttataatatgaatctcacacactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaaggaatctttatacttcagataaagctgttcttgaacatttttttttgtcattatcttagttaaccgagaagatttacaagaatctagacaacatgacaagacttgttagattcactgtgccatttccattgtttgtgtatccaatttatttggtgagtgcttttttttttttacttggaagactacaacacattattattattataatatggttcaaatcaatgacttttaatttctttgtgatgtgcactccattttcagttctcaagaagccccggaaaggaaggttctcacttcaatccctacagcaatctgttcccacccagtgagagaaagggaatagcaatatcaacactgtgttgggttaccatgttttctatgcttatctatctctccttcataactagtccagttctattgctcaagctctatggaattccatattgggtaattaaattactcttacattactttttcctctttttttttatgggtcttaactagtatcacaaaaatattggttaaaaaattttaaaaaaatatttattatgtaaatcataaaagaacataaaaaaaatgatgaataacataattttcgtctcttattaaaaatatttttattttaaatttcttaatcaatatatttagaatctggttaacattttttgaatatttcaattctccaattaaaaatttgaaatagtcaccattaattatgtaattgtttgaacacgtgcagatatttgttatgtggctggactttgtcacatacttgcatcaccatggtcatcatcagaaactgccttggtatcgcggcaaggtaacaaaaataaatagaaaatagtgagtgaacacttaaatgttagatactaccttcttcttcttttttttttttttttgaggttaatgctagataatagctagaaagagaaagaaagacaaatataggtaaaaataaataatataacctgggaagaagaaaacataaaaaaagaaataatagagtctacgtaatgtttggatttttgagtgaaatggtgttcacctaccattactcaaagattctgttgtctacgtagtgtttggactttggagtgaaatggtgttcacctaccattactcagattctgttgtgtcccttagttactgtcttatattcttagggtatattctttattttacatccttttcacatcttacttgaaaagatttttaattattcattgaaatattaacgtgacagttaaattaaaataataaaaaattcgttaaaacttcaaataaataagagtgaaaggatcatcatttttcttctttcttttattgcgttattaatcatgcttctcttcttttttttcttcgctttccacccatatcaaattcatgtgaagtatgagaaaatcacgattcaatggaaagctacaggaactttttttgttttgtttttataatcggaattaatttatactccattttttcacaataaatgttacttagtgccttaaagataatatttgaaaaattaaaaaaattattaatacactgtactactatataatatttgacatatatttaacatgattttctattgaaaatttgtatttattattttttaatcaaaacccataaggcattaatttacaagacccatttttcatttatagctttacctgtgatcatttatagctttaagggacttagatgttacaatcttaattacaagtaaatatttatgaaaaacatgtgtcttaccccttaaccttacctcaacaaagaaagtgtgataagtggcaacacacgtgttgcttttttggcccagcaataacacgtgtttttgtggtgtacaaaaatggacaggaatggagttatttaagaggtggtctcacaactgtggatcgtgactatggttggatcaataacattcaccatgacattggcacccatgttattcaccatcttttccctcaaattcctcattatcacctcgttgaagcggtatattttactattattactcacctaaaaagaatgcaattagtacatttgttttatctcttggaagttagtcattttcagttgcatgattgtaatgttctctctatttttaaaccatgttttcacacctacttcgtttaaaataagaatgtggatactattctaatttctattaacttcttttaaaaaataatgtaaaactagtattaaaaaagaggaaatagattacactctactaatactaatagtataaaaaaaattacattgttattttatcacaaataattatatataattaatttttacaatcattatcttaaaagtcatgtatgatatacagtttttacatgctttggtacttattgtaaagttagtgatttattcattatttatgttatataattggcataaatatcatgtaaccagctcactatactataatgggaacttggtggtgaaaggggtttacaaccctcttttctaggtgtaggtgctttgatacttctggtccctttttatatcaatataaattatattttgctgataaaaaaaacattattaatatataatcattaacttctttaaaaaccgtacctaaaactttatattattaaaaagaagattgagatcagcaaaagaaaaaaaaattaacagtcatttgaattcactgcagacacaagcagcaaaatcagttcttggagagtattaccgtgagccagaaagatctgcaccattaccatttcatctaataaagtatttaattcagagtatgagacaagaccacttcgtaagtgacactggagatgtggtttattatcagactgattctctgcaccttcactcgcaccgagactga

SEQ ID NO: 25 - DNA, 3896 bp, Glycine Max
  FAD3B
atggttaaagacacaaagcctttagcctatgctgccaataatggataccaacaaaagggttcttcttttgattttgatcctagcgctcctccaccgtttaagattgcagaaatcagagcttcaataccaaaacattgctgggtcaagaatccatggagatccctcagttatgttctcagggatgtgcttgtaattgctgcattggtggctgcagcaattcacttcgacaactggcttctctggctaatctattgccccattcaaggcacaatgttctgggctctctttgttcttggacatgattggtaataatttttgtgtttcttactcttttttttttttttttgtttatgatatgaatctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaataagaaatcgcatctggaatgtgaaagttataactatttagcttcatctgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaaagggaatctttatgcttcctgaggctgttcttgaacatggctcttttttatgtgtcattatcttagttaacagagaagatttacaagaatctagacagcatgacaagactcattagattcactgtgccatttccattgtttgtgtatccaatttatttggtgagtgattttttgacttggaagacaacaacacattattattataatatggttcaaaacaatgactttttctttatgatgtgaactccattttttagttttcaagaagccccggaaaggaaggctctcacttcaatccctacagcaatctgtttccacccagtgagagaaaaggaatagcaatatcaacactgtgttgggctaccatgttttctctgcttatctatctctcattcataactagtccacttctagtgctcaagctctatggaattccatattgggtaactaaattactcctacattgttactttttcctccttttttttattatttcaattctccaattggaaatttgaaatagttaccataattatgtaattgtttgatcatgtgcagatatttgttatgtggctggactttgtcacatacttgcatcaccatggtcaccaccagaaactgccttggtaccgcggcaaggtaacaaaaataaatagaaaatagtgggtgaacacttaaatgcgagatagtaatacctaaaaaaagaaaaaaatataggtataataaataatataactttcaaaataaaaagaaatcatagagtctagcgtagtgtttggagtgaaatgatgttcacctaccattactcaaagattttgttgtgtcccttagttcattcttattattttacatatcttacttgaaaagactttttaattattcattgagatcttaaagtgactgttaaattaaaataaaaaacaagtttgttaaaacttcaaataaataagagtgaagggagtgtcatttgtcttctttcttttattgcgttattaatcacgtttctcttctctttttttttttttcttctctgctttccacccattatcaagttcatgtgaagcagtggcggatctatgtaaatgagtggggggcaattgcacccacaagattttattttttatttgtacaggaataataaaataaaactttgcccccataaaaaataaatattttttcttaaaataatgcaaaataaatataagaaataaaaagagaataaattattattaattttattattttgtactttttatttagtttttttagcggttagatttttttttcatgacattatgtaatcttttaaaagcatgtaatatttttattttgtgaaaataaatataaatgatcatattagtctcagaatgtataaactaataataattttatcactaaaagaaattctaatttagtccataaataagtaaaacaagtgacaattatattttatatttacttaatgtgaaataatacttgaacattataataaaacttaatgacaggagatattacatagtgccataaagatattttaaaaaataaaatcattaatacactgtactactatataatattcgatatatatttttaacatgattctcaatagaaaaattgtattgattatattttattagacatgaatttacaagccccgtttttcatttatagctcttacctgtgatctattgttttgcttcgctgtttttgttggtcaagggacttagatgtcacaatattaatactagaagtaaatatttatgaaaacatgtaccttacctcaacaaagaaagtgtggtaagtggcaacacacgtgttgcatttttggcccagcaataacacgtgtttttgtggtgtactaaaatggacaggaatggagttatttaagaggtggcctcaccactgtggatcgtgactatggttggatcaataacattcaccatgacattggcacccatgttatccaccatcttttcccccaaattcctcattatcacctcgttgaagcggtacattttattgcttattcacctaaaaacaatacaattagtacatttgttttatctcttggaagttagtcattttcagttgcatgattctaatgctctctccattcttaaatcatgttttcacacccacttcatttaaaataagaacgtgggtgttattttaatttctattcactaacatgagaaattaacttatttcaagtaataattttaaaatatttttatgctattattttattacaaataattatgtatattaagtttattgattttataataattatattaaaattatatcgatattaatttttgattcactgatagtgttttatattgttagtactgtgcatttattttaaaattggcataaataatatatgtaaccagctcactatactatactgggagcttggtggtgaaaggggttcccaaccctcctttctaggtgtacatgctttgatacttctggtaccttcttatatcaatataaattatattttgctgataaaaaaacatggttaaccattaaattctttttttaaaaaaaaaactgtatctaaactttgtattattaaaaagaagtctgagattaacaataaactaacactcatttgaattcactgcagacacaagcagcaaaaccagttcttggagattactaccgtgagccagaaagatctgcgccattaccatttcatctaataaagtatttaattcagagtatgagacaagaccacttcgtaagtgacactggagatgttgtttattatcagactgattctctgctcctccactcgcaacgagactga

SEQ ID NO: 26 - DNA, 2534 bp, Glycine Max
  FAD3C
atggttcaagcacagcctctacaacatgttggtaatggtgcagggaaagaagatcaagcttattttgatccaagtgctccaccacccttcaagattgcaaatatcagagcagcaattccaaaacattgctgggagaagaacacattgagatctctgagttatgttctgagggatgtgttggtagtgactgcattggtagctgcagcaatcggcttcaatagctggttcttctggccactctattggcctgcacaaggcacaatgttttgggcactttttgttcttggacatgattggtaactaattattattacaaattgttatgttatgttatgttatgttgttgtgcctttttctcagtgatgctttagtcatttcatttcacttggttatgcatgattgttcgttcatatgttctgtcatggtgagttctaatttgattgatgcatggaacagtggtcatggaagtttttcaaacagtcctttgttgaacagcattgtgggccacatcttgcactcttcaattcttgtaccataccatggatggtcggttccttttagcaacttttcatgttcactttgtccttaaatttttttttatgtttgttaaaaaatctttggtctgatttaacaacctaaccatttttacaactcatggattttttgcaggagaattagccacaggactcaccatcagaaccatggccatgttgagaaggatgaatcatgggttccggtattactatgagtttgcttgattaatttccacattttttctttcttcttaattttaatcagtggttagatttggttgtgttccaatagaagaaaagggggtatctagagagatgtgaatttcatgaagtggttcatgattatgtgtctttatgcctttatgtcagcttacagagaaagtttacaagaatctagacaacatgacaagaatgatgagattcactcttcctttccccatctttgcataccccttttatttggtgagaccctctttttccagaatgacagcattattttactatatagtacctcaatttttatatttctaaaattttgaattcttgaaattgaaaggaaaggactttattgggtctagcatctcactctctctttgtgatatgaaccatatatttcagtggagcagaagccctggaaaagaaggctctcatttcaacccttacagcaacttgttctctcctggtgagagaagagatgtgctaacttcaactctgtgttggggcatcatgctttctgtgcttctctatctttccctcacaatgggtccactttttatgctcaagctctatggggttccctatttggtaatctcactctcacactttctttatacatcgcacaccagtgtgggttatttgcaacctacaccgaagtaatgccctataattaatggggttaacacatgtccaagtccaatattttgttcacttatttgaacttgaacatgtgtagatcttcgtcatgtggctggatttcgtcacgtacttgcatcatcatggttacaagcagaaactgccttggtaccgtggccaggtatcccatttaacacaatttgtttcattaacattttaagagaatttttttttcaaaatagttttcgaaattaagcaaataccaagcaaattgttagatctacgcttgtacttgttttaaagtcaaattcatgaccaaattgtcctcacaagtccaaaccgtccactattttattttcacctactttatagcccaatttgtcatttggttacttcagaaaagagaaccccatttgtagtaaatatattatttatgaattatggtagtttcaacataaaacatatttatgtgcagttttgccatccttcaaaagaagatagaaacttactccatgttactctgtctatatgtaatttcacaggaatggagttatctaaggggtggtcttacaacagtagatcgcgactatggttggatcaacaacattcaccatgacattggcacccatgttatccatcaccttttccctcaaattccacattatcatttaatcgaagcggtattaattctctatttcacaagaaattattgtatgtctgcctatgtgatctaagtcaattttcacataacacatgatcaaactttcttaattctttcttctaaattgaaaaagtggattatatgtcaattgaaaattggtcaagaccacaaacatgtgatgatctcccaccttacatataataatttctcctattctacaatcaataatccttctatggtcctgaattgttcctttcttttttcattttcttattctttttgttgtcccacaatagactaaagcagcaaaggcagtgctaggaaagtattatcgtgagcctcagaaatctgggccattgccacttcatctaataaagtacttgctccacagcataagtcaggatcacttcgttagcgactctggcgacattgtgtactaccagactgattcccagctccacaaagattcttggacccagtccaactaa

SEQ ID NO: 27 - DNA, 23 bp, Glycine Max
  FAD2 TALEN target sequence
gccaccacctacttccacctcct

SEQ ID NO: 28 - DNA, 16 bp, Glycine Max
  FAD2 TALEN target sequence
attgcatggccaatct

SEQ ID NO: 29 - DNA, 23 bp, Glycine Max
  FAD2 TALEN target sequence
gccaccacctacttccacctcct

SEQ ID NO: 30 - DNA, 16 bp, Glycine Max
  FAD2 TALEN target sequence
attgcatggccaatct

SEQ ID NO: 31 - DNA, 25 bp, Glycine Max
  FAD2 TALEN target sequence
acattgccaccacctacttccacct

SEQ ID NO: 32 - DNA, 16 bp, Glycine Max
  FAD2 TALEN target sequence
attgcatggccaatct

SEQ ID NO: 33 - DNA, 25 bp, Glycine Max
  FAD2 TALEN target sequence
acattgccaccacctacttccacct

SEQ ID NO: 34 - DNA, 16 bp, Glycine Max
  FAD2 TALEN target sequence
attgcatggccaatct

SEQ ID NO: 35 - DNA, 19 bp, Glycine Max
  FAD2 TALEN target sequence
ctcatggaaaataagccat

SEQ ID NO: 36 - DNA, 22 bp, Glycine Max
  FAD2 TALEN target sequence
accgtgatgaagtgtttgtccc

SEQ ID NO: 37 - DNA, 19 bp, Glycine Max
  FAD2 TALEN target sequence
ctcatggaaaataagccat

SEQ ID NO: 38 - DNA, 22 bp, Glycine Max
  FAD2 TALEN target sequence
accgtgatgaagtgtttgtccc

SEQ ID NO: 39 - DNA, 23 bp, Glycine Max
  FAD2 TALEN target sequence
atttctcatggaaaataagccat

SEQ ID NO: 40 - DNA, 22 bp, Glycine Max
  FAD2 TALEN target sequence
accgtgatgaagtgtttgtccc

SEQ ID NO: 41 - DNA, 23 bp, Glycine Max
  FAD2 TALEN target sequence
atttctcatggaaaataagccat

SEQ ID NO: 42 - DNA, 22 bp, Glycine Max
  FAD2 TALEN target sequence
accgtgatgaagtgtttgtccc

SEQ ID NO: 43 - DNA, 1331 bp, Glycine Max; identical to SEQ ID NO: 4
  FAD2-1A

SEQ ID NO: 44 - DNA, 1324 bp, Glycine Max; identical to SEQ ID NO: 5
  FAD2-1B

SEQ ID NO: 45 - DNA, 47 bp, Glycine Max
  FAD3A
ctaaatagcctggtgggacacatcttgcattcctcaattcttgtgcc

SEQ ID NO: 46 - DNA, 40 bp, Artificial
  FAD3A mutant
ctaaatagcctggtgggacgcattcctcaattcttgtgcc

SEQ ID NO: 47 - DNA, 40 bp, Artificial
  FAD3A mutant
ctaaatagcctggtgggacactttcctcaattcttgtgcc

SEQ ID NO: 48 - DNA, 39 bp, Artificial
  FAD3A mutant
ctaaatagcctggtgggagcattcctcaattcttgtgcc

SEQ ID NO: 49 - DNA, 43 bp, Artificial
  FAD3A mutant
ctaaatagcctggtgggacacagcattcctcaattcttgtgcc

SEQ ID NO: 50 - DNA, 40 bp, Artificial
  FAD3A mutant
ctaaatagcctggtgggatgcattcctcaattcttgtgcc

SEQ ID NO: 51 - DNA, 41 bp, Artificial
  FAD3A mutant
ctaaatagcctggtgggacagcattcctcaattcttgtgcc

SEQ ID NO: 52 - DNA, 38 bp, Artificial
  FAD3A mutant
ctaaatagcctggtgggcacttcctcaattcttgtgcc

SEQ ID NO: 53 - DNA, 47 bp, Glycine Max
  FAD3B
ctgaatagcctggtgggacacatcttgcattcctcaattcttgtgcc

SEQ ID NO: 54 - DNA, 42 bp, Artificial
  FAD3B mutant
ctgaatagcctggtgggacatgcattcctcaattcttgtgcc

SEQ ID NO: 55 - DNA, 44 bp, Artificial
  FAD3B mutant
ctgaatagcctggtgggacacatgcattcctcaattcttgtgcc

SEQ ID NO: 56 - DNA, 40 bp, Artificial
  FAD3B mutant
ctgaatagcctggtgggacacattcctcaattcttgtgcc

SEQ ID NO: 57 - DNA, 41 bp, Artificial
  FAD3B mutant
ctgaatagcctggtgggacagcattcctcaattcttgtgcc

SEQ ID NO: 58 - DNA, 38 bp, Artificial
  FAD3B mutant
ctgaatagcctggtgggacattcctcaattcttgtgcc

SEQ ID NO: 59 - DNA, 42 bp, Artificial
  FAD3B mutant
ctgaatagcctggtgggacacgcattcctcaattcttgtgcc

SEQ ID NO: 60 - DNA, 41 bp, Artificial; identical to SEQ ID NO: 57
  FAD3B mutant

SEQ ID NO: 61 - DNA, 93 bp, Glycine Max
  FAD2-1A
aacacttttagtcccttatttctcatggaaaataagccatcgccgccatcactccaacacaggttcccttgaccgtgatgaagtgtttgtccc

SEQ ID NO: 62 - DNA, 30 bp, Glycine Max
  FAD2-1A -63 bp mutant
aacacttgaccgtgatgaagtgtttgtccc

SEQ ID NO: 63 - DNA, 93 bp, Glycine Max
  FAD2-1B
agcacttttagtcccttatttctcatggaaaataagccatcgccgccaccactccaacacgggttcccttgaccgtgatgaagtgtttgtccc

SEQ ID NO: 64 - DNA, 3861 bp, Artificial
  Gm183-1 FAD3A Allele #1
atggttaaagacacaaagcctttagcctatgctgctaataatggataccaaaaggaagcttttgatcccagtgctcctccaccgtttaagattgcagaaatcagagttgcaataccaaaacattgctgggtcaagaatccatggagatccctcagttatgttctcagggatgtgcttgtaattgctgcattgatggctgctgcaagtcacttcaacaactggcttctctggctaatctattggcccattcaaggaacaatgttctgggctctgtttgttcttggacatgattggtaattaattaatttgttgttacttttttgttataatatgaatctcacacactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaaggaatctttatacttcagataaagctgttcttgaacatttttttttgtcattatcttagttaaccgagaagatttacaagaatctagacaacatgacaagacttgttagattcactgtgccatttccattgtttgtgtatccaatttatttggtgagtgcttttttttttttacttggaagactacaacacattattattattataatatggttcaaatcaatgacttttaatttctttgtgatgtgcactccattttcagttctcaagaagccccggaaaggaaggttctcacttcaatccctacagcaatctgttcccacccagtgagagaaagggaatagcaatatcaacactgtgttgggttaccatgttttctatgcttatctatctctccttcataactagtccagttctattgctcaagctctatggaattccatattgggtaattaaattactcttacattactttttcctctttttttttatgggtcttaactagtatcacaaaaatattggttaaaaaattttaaaaaaatatttattatgtaaatcataaaagaacataaaaaaaatgatgaataacataattttcgtctcttattaaaaatatttttattttaaatttcttaatcaatatatttagaatctggttaacattttttgaatatttcaattctccaattaaaaatttgaaatagtcaccattaattatgtaattgtttgaacacgtgcagatatttgttatgtggctggactttgtcacatacttgcatcaccatggtcatcatcagaaactgccttggtatcgcggcaaggtaacaaaaataaatagaaaatagtgagtgaacacttaaatgttagatactaccttcttcttcttttttttttttttttgaggttaatgctagataatagctagaaagagaaagaaagacaaatataggtaaaaataaataatataacctgggaagaagaaaacataaaaaaagaaataatagagtctacgtaatgtttggatttttgagtgaaatggtgttcacctaccattactcaaagattctgttgtctacgtagtgtttggactttggagtgaaatggtgttcacctaccattactcagattctgttgtgtcccttagttactgtcttatattcttagggtatattctttattttacatccttttcacatcttacttgaaaagatttttaattattcattgaaatattaacgtgacagttaaattaaaataataaaaaattcgttaaaacttcaaataaataagagtgaaaggatcatcatttttcttctttcttttattgcgttattaatcatgcttctcttcttttttttcttcgctttccacccatatcaaattcatgtgaagtatgagaaaatcacgattcaatggaaagctacaggaactttttttgttttgtttttataatcggaattaatttatactccattttttcacaataaatgttacttagtgccttaaagataatatttgaaaaattaaaaaaattattaatacactgtactactatataatatttgacatatatttaacatgattttctattgaaaatttgtatttattattttttaatcaaaacccataaggcattaatttacaagacccatttttcatttatagctttacctgtgatcatttatagctttaagggacttagatgttacaatcttaattacaagtaaatatttatgaaaaacatgtgtcttaccccttaaccttacctcaacaaagaaagtgtgataagtggcaacacacgtgttgcttttttggcccagcaataacacgtgtttttgtggtgtacaaaaatggacaggaatggagttatttaagaggtggtctcacaactgtggatcgtgactatggttggatcaataacattcaccatgacattggcacccatgttattcaccatcttttccctcaaattcctcattatcacctcgttgaagcggtatattttactattattactcacctaaaaagaatgcaattagtacatttgttttatctcttggaagttagtcattttcagttgcatgattgtaatgttctctctatttttaaaccatgttttcacacctacttcgtttaaaataagaatgtggatactattctaatttctattaacttcttttaaaaaataatgtaaaactagtattaaaaaagaggaaatagattacactctactaatactaatagtataaaaaaaattacattgttattttatcacaaataattatatataattaatttttacaatcattatcttaaaagtcatgtatgatatacagtttttacatgctttggtacttattgtaaagttagtgatttattcattatttatgttatataattggcataaatatcatgtaaccagctcactatactataatgggaacttggtggtgaaaggggtttacaaccctcttttctaggtgtaggtgctttgatacttctggtccctttttatatcaatataaattatattttgctgataaaaaaaacattattaatatataatcattaacttctttaaaaaccgtacctaaaactttatattattaaaaagaagattgagatcagcaaaagaaaaaaaaattaacagtcatttgaattcactgcagacacaagcagcaaaatcagttcttggagagtattaccgtgagccagaaagatctgcaccattaccatttcatctaataaagtatttaattcagagtatgagacaagaccacttcgtaagtgacactggagatgtggtttattatcagactgattctctgcaccttcactcgcaccgagactga

SEQ ID NO: 65 - DNA, 3861 bp, Artificial
  Gm183-2 Allele #1
atggttaaagacacaaagcctttagcctatgctgctaataatggataccaaaaggaagcttttgatcccagtgctcctccaccgtttaagattgcagaaatcagagttgcaataccaaaacattgctgggtcaagaatccatggagatccctcagttatgttctcagggatgtgcttgtaattgctgcattgatggctgctgcaagtcacttcaacaactggcttctctggctaatctattggcccattcaaggaacaatgttctgggctctgtttgttcttggacatgattggtaattaattaatttgttgttacttttttgttataatatgaatctcacacactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacactttcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaaggaatctttatacttcagataaagctgttcttgaacatttttttttgtcattatcttagttaaccgagaagatttacaagaatctagacaacatgacaagacttgttagattcactgtgccatttccattgtttgtgtatccaatttatttggtgagtgcttttttttttttacttggaagactacaacacattattattattataatatggttcaaatcaatgacttttaatttctttgtgatgtgcactccattttcagttctcaagaagccccggaaaggaaggttctcacttcaatccctacagcaatctgttcccacccagtgagagaaagggaatagcaatatcaacactgtgttgggttaccatgttttctatgcttatctatctctccttcataactagtccagttctattgctcaagctctatggaattccatattgggtaattaaattactcttacattactttttcctctttttttttatgggtcttaactagtatcacaaaaatattggttaaaaaattttaaaaaaatatttattatgtaaatcataaaagaacataaaaaaaatgatgaataacataattttcgtctcttattaaaaatatttttattttaaatttcttaatcaatatatttagaatctggttaacattttttgaatatttcaattctccaattaaaaatttgaaatagtcaccattaattatgtaattgtttgaacacgtgcagatatttgttatgtggctggactttgtcacatacttgcatcaccatggtcatcatcagaaactgccttggtatcgcggcaaggtaacaaaaataaatagaaaatagtgagtgaacacttaaatgttagatactaccttcttcttcttttttttttttttttgaggttaatgctagataatagctagaaagagaaagaaagacaaatataggtaaaaataaataatataacctgggaagaagaaaacataaaaaaagaaataatagagtctacgtaatgtttggatttttgagtgaaatggtgttcacctaccattactcaaagattctgttgtctacgtagtgtttggactttggagtgaaatggtgttcacctaccattactcagattctgttgtgtcccttagttactgtcttatattcttagggtatattctttattttacatccttttcacatcttacttgaaaagatttttaattattcattgaaatattaacgtgacagttaaattaaaataataaaaaattcgttaaaacttcaaataaataagagtgaaaggatcatcatttttcttctttcttttattgcgttattaatcatgcttctcttcttttttttcttcgctttccacccatatcaaattcatgtgaagtatgagaaaatcacgattcaatggaaagctacaggaactttttttgttttgtttttataatcggaattaatttatactccattttttcacaataaatgttacttagtgccttaaagataatatttgaaaaattaaaaaaattattaatacactgtactactatataatatttgacatatatttaacatgattttctattgaaaatttgtatttattattttttaatcaaaacccataaggcattaatttacaagacccatttttcatttatagctttacctgtgatcatttatagctttaagggacttagatgttacaatcttaattacaagtaaatatttatgaaaaacatgtgtcttaccccttaaccttacctcaacaaagaaagtgtgataagtggcaacacacgtgttgcttttttggcccagcaataacacgtgtttttgtggtgtacaaaaatggacaggaatggagttatttaagaggtggtctcacaactgtggatcgtgactatggttggatcaataacattcaccatgacattggcacccatgttattcaccatcttttccctcaaattcctcattatcacctcgttgaagcggtatattttactattattactcacctaaaaagaatgcaattagtacatttgttttatctcttggaagttagtcattttcagttgcatgattgtaatgttctctctatttttaaaccatgttttcacacctacttcgtttaaaataagaatgtggatactattctaatttctattaacttcttttaaaaaataatgtaaaactagtattaaaaaagaggaaatagattacactctactaatactaatagtataaaaaaaattacattgttattttatcacaaataattatatataattaatttttacaatcattatcttaaaagtcatgtatgatatacagtttttacatgctttggtacttattgtaaagttagtgatttattcattatttatgttatataattggcataaatatcatgtaaccagctcactatactataatgggaacttggtggtgaaaggggtttacaaccctcttttctaggtgtaggtgctttgatacttctggtccctttttatatcaatataaattatattttgctgataaaaaaaacattattaatatataatcattaacttctttaaaaaccgtacctaaaactttatattattaaaaagaagattgagatcagcaaaagaaaaaaaaattaacagtcatttgaattcactgcagacacaagcagcaaaatcagttcttggagagtattaccgtgagccagaaagatctgcaccattaccatttcatctaataaagtatttaattcagagtatgagacaagaccacttcgtaagtgacactggagatgtggtttattatcagactgattctctgcaccttcactcgcaccgagactga

SEQ ID NO: 66 - DNA, 3861 bp, Artificial; identical to SEQ ID NO: 65
  Gm183-2 FAD3A Allele #2

SEQ ID NO: 67 - DNA, 3864 bp, Artificial
  Gm183-4 FAD3A Allele #1
atggttaaagacacaaagcctttagcctatgctgctaataatggataccaaaaggaagcttttgatcccagtgctcctccaccgtttaagattgcagaaatcagagttgcaataccaaaacattgctgggtcaagaatccatggagatccctcagttatgttctcagggatgtgcttgtaattgctgcattgatggctgctgcaagtcacttcaacaactggcttctctggctaatctattggcccattcaaggaacaatgttctgggctctgtttgttcttggacatgattggtaattaattaatttgttgttacttttttgttataatatgaatctcacacactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacagcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaaggaatctttatacttcagataaagctgttcttgaacatttttttttgtcattatcttagttaaccgagaagatttacaagaatctagacaacatgacaagacttgttagattcactgtgccatttccattgtttgtgtatccaatttatttggtgagtgcttttttttttttacttggaagactacaacacattattattattataatatggttcaaatcaatgacttttaatttctttgtgatgtgcactccattttcagttctcaagaagccccggaaaggaaggttctcacttcaatccctacagcaatctgttcccacccagtgagagaaagggaatagcaatatcaacactgtgttgggttaccatgttttctatgcttatctatctctccttcataactagtccagttctattgctcaagctctatggaattccatattgggtaattaaattactcttacattactttttcctctttttttttatgggtcttaactagtatcacaaaaatattggttaaaaaattttaaaaaaatatttattatgtaaatcataaaagaacataaaaaaaatgatgaataacataattttcgtctcttattaaaaatatttttattttaaatttcttaatcaatatatttagaatctggttaacattttttgaatatttcaattctccaattaaaaatttgaaatagtcaccattaattatgtaattgtttgaacacgtgcagatatttgttatgtggctggactttgtcacatacttgcatcaccatggtcatcatcagaaactgccttggtatcgcggcaaggtaacaaaaataaatagaaaatagtgagtgaacacttaaatgttagatactaccttcttcttcttttttttttttttttgaggttaatgctagataatagctagaaagagaaagaaagacaaatataggtaaaaataaataatataacctgggaagaagaaaacataaaaaaagaaataatagagtctacgtaatgtttggatttttgagtgaaatggtgttcacctaccattactcaaagattctgttgtctacgtagtgtttggactttggagtgaaatggtgttcacctaccattactcagattctgttgtgtcccttagttactgtcttatattcttagggtatattctttattttacatccttttcacatcttacttgaaaagatttttaattattcattgaaatattaacgtgacagttaaattaaaataataaaaaattcgttaaaacttcaaataaataagagtgaaaggatcatcatttttcttctttcttttattgcgttattaatcatgcttctcttcttttttttcttcgctttccacccatatcaaattcatgtgaagtatgagaaaatcacgattcaatggaaagctacaggaactttttttgttttgtttttataatcggaattaatttatactccattttttcacaataaatgttacttagtgccttaaagataatatttgaaaaattaaaaaaattattaatacactgtactactatataatatttgacatatatttaacatgattttctattgaaaatttgtatttattattttttaatcaaaacccataaggcattaatttacaagacccatttttcatttatagctttacctgtgatcatttatagctttaagggacttagatgttacaatcttaattacaagtaaatatttatgaaaaacatgtgtcttaccccttaaccttacctcaacaaagaaagtgtgataagtggcaacacacgtgttgcttttttggcccagcaataacacgtgtttttgtggtgtacaaaaatggacaggaatggagttatttaagaggtggtctcacaactgtggatcgtgactatggttggatcaataacattcaccatgacattggcacccatgttattcaccatcttttccctcaaattcctcattatcacctcgttgaagcggtatattttactattattactcacctaaaaagaatgcaattagtacatttgttttatctcttggaagttagtcattttcagttgcatgattgtaatgttctctctatttttaaaccatgttttcacacctacttcgtttaaaataagaatgtggatactattctaatttctattaacttcttttaaaaaataatgtaaaactagtattaaaaaagaggaaatagattacactctactaatactaatagtataaaaaaaattacattgttattttatcacaaataattatatataattaatttttacaatcattatcttaaaagtcatgtatgatatacagtttttacatgctttggtacttattgtaaagttagtgatttattcattatttatgttatataattggcataaatatcatgtaaccagctcactatactataatgggaacttggtggtgaaaggggtttacaaccctcttttctaggtgtaggtgctttgatacttctggtccctttttatatcaatataaattatattttgctgataaaaaaaacattattaatatataatcattaacttctttaaaaaccgtacctaaaactttatattattaaaaagaagattgagatcagcaaaagaaaaaaaaattaacagtcatttgaattcactgcagacacaagcagcaaaatcagttcttggagagtattaccgtgagccagaaagatctgcaccattaccatttcatctaataaagtatttaattcagagtatgagacaagaccacttcgtaagtgacactggagatgtggtttattatcagactgattctctgcaccttcactcgcaccgagactga

SEQ ID NO: 68 - DNA, 3861 bp, Artificial
  Gm183-5 FAD3A Allele #1 (SEQ ID NO:68)
atggttaaagacacaaagcctttagcctatgctgctaataatggataccaaaaggaagcttttgatcccagtgctcctccaccgtttaagattgcagaaatcagagttgcaataccaaaacattgctgggtcaagaatccatggagatccctcagttatgttctcagggatgtgcttgtaattgctgcattgatggctgctgcaagtcacttcaacaactggcttctctggctaatctattggcccattcaaggaacaatgttctgggctctgtttgttcttggacatgattggtaattaattaatttgttgttacttttttgttataatatgaatctcacacactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggatgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaaggaatctttatacttcagataaagctgttcttgaacatttttttttgtcattatcttagttaaccgagaagatttacaagaatctagacaacatgacaagacttgttagattcactgtgccatttccattgtttgtgtatccaatttatttggtgagtgcttttttttttttacttggaagactacaacacattattattattataatatggttcaaatcaatgacttttaatttctttgtgatgtgcactccattttcagttctcaagaagccccggaaaggaaggttctcacttcaatccctacagcaatctgttcccacccagtgagagaaagggaatagcaatatcaacactgtgttgggttaccatgttttctatgcttatctatctctccttcataactagtccagttctattgctcaagctctatggaattccatattgggtaattaaattactcttacattactttttcctctttttttttatgggtcttaactagtatcacaaaaatattggttaaaaaattttaaaaaaatatttattatgtaaatcataaaagaacataaaaaaaatgatgaataacataattttcgtctcttattaaaaatatttttattttaaatttcttaatcaatatatttagaatctggttaacattttttgaatatttcaattctccaattaaaaatttgaaatagtcaccattaattatgtaattgtttgaacacgtgcagatatttgttatgtggctggactttgtcacatacttgcatcaccatggtcatcatcagaaactgccttggtatcgcggcaaggtaacaaaaataaatagaaaatagtgagtgaacacttaaatgttagatactaccttcttcttcttttttttttttttttgaggttaatgctagataatagctagaaagagaaagaaagacaaatataggtaaaaataaataatataacctgggaagaagaaaacataaaaaaagaaataatagagtctacgtaatgtttggatttttgagtgaaatggtgttcacctaccattactcaaagattctgttgtctacgtagtgtttggactttggagtgaaatggtgttcacctaccattactcagattctgttgtgtcccttagttactgtcttatattcttagggtatattctttattttacatccttttcacatcttacttgaaaagatttttaattattcattgaaatattaacgtgacagttaaattaaaataataaaaaattcgttaaaacttcaaataaataagagtgaaaggatcatcatttttcttctttcttttattgcgttattaatcatgcttctcttcttttttttcttcgctttccacccatatcaaattcatgtgaagtatgagaaaatcacgattcaatggaaagctacaggaactttttttgttttgtttttataatcggaattaatttatactccattttttcacaataaatgttacttagtgccttaaagataatatttgaaaaattaaaaaaattattaatacactgtactactatataatatttgacatatatttaacatgattttctattgaaaatttgtatttattattttttaatcaaaacccataaggcattaatttacaagacccatttttcatttatagctttacctgtgatcatttatagctttaagggacttagatgttacaatcttaattacaagtaaatatttatgaaaaacatgtgtcttaccccttaaccttacctcaacaaagaaagtgtgataagtggcaacacacgtgttgcttttttggcccagcaataacacgtgtttttgtggtgtacaaaaatggacaggaatggagttatttaagaggtggtctcacaactgtggatcgtgactatggttggatcaataacattcaccatgacattggcacccatgttattcaccatcttttccctcaaattcctcattatcacctcgttgaagcggtatattttactattattactcacctaaaaagaatgcaattagtacatttgttttatctcttggaagttagtcattttcagttgcatgattgtaatgttctctctatttttaaaccatgttttcacacctacttcgtttaaaataagaatgtggatactattctaatttctattaacttcttttaaaaaataatgtaaaactagtattaaaaaagaggaaatagattacactctactaatactaatagtataaaaaaaattacattgttattttatcacaaataattatatataattaatttttacaatcattatcttaaaagtcatgtatgatatacagtttttacatgctttggtacttattgtaaagttagtgatttattcattatttatgttatataattggcataaatatcatgtaaccagctcactatactataatgggaacttggtggtgaaaggggtttacaaccctcttttctaggtgtaggtgctttgatacttctggtccctttttatatcaatataaattatattttgctgataaaaaaaacattattaatatataatcattaacttctttaaaaaccgtacctaaaactttatattattaaaaagaagattgagatcagcaaaagaaaaaaaaattaacagtcatttgaattcactgcagacacaagcagcaaaatcagttcttggagagtattaccgtgagccagaaagatctgcaccattaccatttcatctaataaagtatttaattcagagtatgagacaagaccacttcgtaagtgacactggagatgtggtttattatcagactgattctctgcaccttcactcgcaccgagactga

SEQ ID NO: 69 - DNA, 3862 bp, Artificial
  Gm183-6 FAD3A Allele #1 (SEQ ID NO:69)
atggttaaagacacaaagcctttagcctatgctgctaataatggataccaaaaggaagcttttgatcccagtgctcctccaccgtttaagattgcagaaatcagagttgcaataccaaaacattgctgggtcaagaatccatggagatccctcagttatgttctcagggatgtgcttgtaattgctgcattgatggctgctgcaagtcacttcaacaactggcttctctggctaatctattggcccattcaaggaacaatgttctgggctctgtttgttcttggacatgattggtaattaattaatttgttgttacttttttgttataatatgaatctcacacactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacagcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaaggaatctttatacttcagataaagctgttcttgaacatttttttttgtcattatcttagttaaccgagaagatttacaagaatctagacaacatgacaagacttgttagattcactgtgccatttccattgtttgtgtatccaatttatttggtgagtgcttttttttttttacttggaagactacaacacattattattattataatatggttcaaatcaatgacttttaatttctttgtgatgtgcactccattttcagttctcaagaagccccggaaaggaaggttctcacttcaatccctacagcaatctgttcccacccagtgagagaaagggaatagcaatatcaacactgtgttgggttaccatgttttctatgcttatctatctctccttcataactagtccagttctattgctcaagctctatggaattccatattgggtaattaaattactcttacattactttttcctctttttttttatgggtcttaactagtatcacaaaaatattggttaaaaaattttaaaaaaatatttattatgtaaatcataaaagaacataaaaaaaatgatgaataacataattttcgtctcttattaaaaatatttttattttaaatttcttaatcaatatatttagaatctggttaacattttttgaatatttcaattctccaattaaaaatttgaaatagtcaccattaattatgtaattgtttgaacacgtgcagatatttgttatgtggctggactttgtcacatacttgcatcaccatggtcatcatcagaaactgccttggtatcgcggcaaggtaacaaaaataaatagaaaatagtgagtgaacacttaaatgttagatactaccttcttcttcttttttttttttttttgaggttaatgctagataatagctagaaagagaaagaaagacaaatataggtaaaaataaataatataacctgggaagaagaaaacataaaaaaagaaataatagagtctacgtaatgtttggatttttgagtgaaatggtgttcacctaccattactcaaagattctgttgtctacgtagtgtttggactttggagtgaaatggtgttcacctaccattactcagattctgttgtgtcccttagttactgtcttatattcttagggtatattctttattttacatccttttcacatcttacttgaaaagatttttaattattcattgaaatattaacgtgacagttaaattaaaataataaaaaattcgttaaaacttcaaataaataagagtgaaaggatcatcatttttcttctttcttttattgcgttattaatcatgcttctcttcttttttttcttcgctttccacccatatcaaattcatgtgaagtatgagaaaatcacgattcaatggaaagctacaggaactttttttgttttgtttttataatcggaattaatttatactccattttttcacaataaatgttacttagtgccttaaagataatatttgaaaaattaaaaaaattattaatacactgtactactatataatatttgacatatatttaacatgattttctattgaaaatttgtatttattattttttaatcaaaacccataaggcattaatttacaagacccatttttcatttatagctttacctgtgatcatttatagctttaagggacttagatgttacaatcttaattacaagtaaatatttatgaaaaacatgtgtcttaccccttaaccttacctcaacaaagaaagtgtgataagtggcaacacacgtgttgcttttttggcccagcaataacacgtgtttttgtggtgtacaaaaatggacaggaatggagttatttaagaggtggtctcacaactgtggatcgtgactatggttggatcaataacattcaccatgacattggcacccatgttattcaccatcttttccctcaaattcctcattatcacctcgttgaagcggtatattttactattattactcacctaaaaagaatgcaattagtacatttgttttatctcttggaagttagtcattttcagttgcatgattgtaatgttctctctatttttaaaccatgttttcacacctacttcgtttaaaataagaatgtggatactattctaatttctattaacttcttttaaaaaataatgtaaaactagtattaaaaaagaggaaatagattacactctactaatactaatagtataaaaaaaattacattgttattttatcacaaataattatatataattaatttttacaatcattatcttaaaagtcatgtatgatatacagtttttacatgctttggtacttattgtaaagttagtgatttattcattatttatgttatataattggcataaatatcatgtaaccagctcactatactataatgggaacttggtggtgaaaggggtttacaaccctcttttctaggtgtaggtgctttgatacttctggtccctttttatatcaatataaattatattttgctgataaaaaaaacattattaatatataatcattaacttctttaaaaaccgtacctaaaactttatattattaaaaagaagattgagatcagcaaaagaaaaaaaaattaacagtcatttgaattcactgcagacacaagcagcaaaatcagttcttggagagtattaccgtgagccagaaagatctgcaccattaccatttcatctaataaagtatttaattcagagtatgagacaagaccacttcgtaagtgacactggagatgtggtttattatcagactgattctctgcaccttcactcgcaccgagactga

SEQ ID NO: 70 - DNA, 3862 bp, Artificial; identical to SEQ ID NO: 69
  Gm183-6 FAD3A Allele #2 (SEQ ID NO:70)

SEQ ID NO: 71 - DNA, 3861 bp, Artificial
  Gm183-6 FAD3A Allele #3 (SEQ ID NO:71)
atggttaaagacacaaagcctttagcctatgctgctaataatggataccaaaaggaagcttttgatcccagtgctcctccaccgtttaagattgcagaaatcagagttgcaataccaaaacattgctgggtcaagaatccatggagatccctcagttatgttctcagggatgtgcttgtaattgctgcattgatggctgctgcaagtcacttcaacaactggcttctctggctaatctattggcccattcaaggaacaatgttctgggctctgtttgttcttggacatgattggtaattaattaatttgttgttacttttttgttataatatgaatctcacacactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaaggaatctttatacttcagataaagctgttcttgaacatttttttttgtcattatcttagttaaccgagaagatttacaagaatctagacaacatgacaagacttgttagattcactgtgccatttccattgtttgtgtatccaatttatttggtgagtgcttttttttttttacttggaagactacaacacattattattattataatatggttcaaatcaatgacttttaatttctttgtgatgtgcactccattttcagttctcaagaagccccggaaaggaaggttctcacttcaatccctacagcaatctgttcccacccagtgagagaaagggaatagcaatatcaacactgtgttgggttaccatgttttctatgcttatctatctctccttcataactagtccagttctattgctcaagctctatggaattccatattgggtaattaaattactcttacattactttttcctctttttttttatgggtcttaactagtatcacaaaaatattggttaaaaaattttaaaaaaatatttattatgtaaatcataaaagaacataaaaaaaatgatgaataacataattttcgtctcttattaaaaatatttttattttaaatttcttaatcaatatatttagaatctggttaacattttttgaatatttcaattctccaattaaaaatttgaaatagtcaccattaattatgtaattgtttgaacacgtgcagatatttgttatgtggctggactttgtcacatacttgcatcaccatggtcatcatcagaaactgccttggtatcgcggcaaggtaacaaaaataaatagaaaatagtgagtgaacacttaaatgttagatactaccttcttcttcttttttttttttttttgaggttaatgctagataatagctagaaagagaaagaaagacaaatataggtaaaaataaataatataacctgggaagaagaaaacataaaaaaagaaataatagagtctacgtaatgtttggatttttgagtgaaatggtgttcacctaccattactcaaagattctgttgtctacgtagtgtttggactttggagtgaaatggtgttcacctaccattactcagattctgttgtgtcccttagttactgtcttatattcttagggtatattctttattttacatccttttcacatcttacttgaaaagatttttaattattcattgaaatattaacgtgacagttaaattaaaataataaaaaattcgttaaaacttcaaataaataagagtgaaaggatcatcatttttcttctttcttttattgcgttattaatcatgcttctcttcttttttttcttcgctttccacccatatcaaattcatgtgaagtatgagaaaatcacgattcaatggaaagctacaggaactttttttgttttgtttttataatcggaattaatttatactccattttttcacaataaatgttacttagtgccttaaagataatatttgaaaaattaaaaaaattattaatacactgtactactatataatatttgacatatatttaacatgattttctattgaaaatttgtatttattattttttaatcaaaacccataaggcattaatttacaagacccatttttcatttatagctttacctgtgatcatttatagctttaagggacttagatgttacaatcttaattacaagtaaatatttatgaaaaacatgtgtcttaccccttaaccttacctcaacaaagaaagtgtgataagtggcaacacacgtgttgcttttttggcccagcaataacacgtgtttttgtggtgtacaaaaatggacaggaatggagttatttaagaggtggtctcacaactgtggatcgtgactatggttggatcaataacattcaccatgacattggcacccatgttattcaccatcttttccctcaaattcctcattatcacctcgttgaagcggtatattttactattattactcacctaaaaagaatgcaattagtacatttgttttatctcttggaagttagtcattttcagttgcatgattgtaatgttctctctatttttaaaccatgttttcacacctacttcgtttaaaataagaatgtggatactattctaatttctattaacttcttttaaaaaataatgtaaaactagtattaaaaaagaggaaatagattacactctactaatactaatagtataaaaaaaattacattgttattttatcacaaataattatatataattaatttttacaatcattatcttaaaagtcatgtatgatatacagtttttacatgctttggtacttattgtaaagttagtgatttattcattatttatgttatataattggcataaatatcatgtaaccagctcactatactataatgggaacttggtggtgaaaggggtttacaaccctcttttctaggtgtaggtgctttgatacttctggtccctttttatatcaatataaattatattttgctgataaaaaaaacattattaatatataatcattaacttctttaaaaaccgtacctaaaactttatattattaaaaagaagattgagatcagcaaaagaaaaaaaaattaacagtcatttgaattcactgcagacacaagcagcaaaatcagttcttggagagtattaccgtgagccagaaagatctgcaccattaccatttcatctaataaagtatttaattcagagtatgagacaagaccacttcgtaagtgacactggagatgtggtttattatcagactgattctctgcaccttcactcgcaccgagactga

SEQ ID NO: 72 - DNA, 3868 bp, Artificial; identical to SEQ ID NO: 24
  Gm183-6 FAD3A Allele #4 (SEQ ID NO:72)

SEQ ID NO: 73 - DNA, 3857 bp, Artificial
  Gm183-6 FAD3A Allele #5 (SEQ ID NO:73)
atggttaaagacacaaagcctttagcctatgctgctaataatggataccaaaaggaagcttttgatcccagtgctcctccaccgtttaagattgcagaaatcagagttgcaataccaaaacattgctgggtcaagaatccatggagatccctcagttatgttctcagggatgtgcttgtaattgctgcattgatggctgctgcaagtcacttcaacaactggcttctctggctaatctattggcccattcaaggaacaatgttctgggctctgtttgttcttggacatgattggtaattaattaatttgttgttacttttttgttataatatgaatctcacacactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaaggaatctttatacttcagataaagctgttcttgaacatttttttttgtcattatcttagttaaccgagaagatttacaagaatctagacaacatgacaagacttgttagattcactgtgccatttccattgtttgtgtatccaatttatttggtgagtgcttttttttttttacttggaagactacaacacattattattattataatatggttcaaatcaatgacttttaatttctttgtgatgtgcactccattttcagttctcaagaagccccggaaaggaaggttctcacttcaatccctacagcaatctgttcccacccagtgagagaaagggaatagcaatatcaacactgtgttgggttaccatgttttctatgcttatctatctctccttcataactagtccagttctattgctcaagctctatggaattccatattgggtaattaaattactcttacattactttttcctctttttttttatgggtcttaactagtatcacaaaaatattggttaaaaaattttaaaaaaatatttattatgtaaatcataaaagaacataaaaaaaatgatgaataacataattttcgtctcttattaaaaatatttttattttaaatttcttaatcaatatatttagaatctggttaacattttttgaatatttcaattctccaattaaaaatttgaaatagtcaccattaattatgtaattgtttgaacacgtgcagatatttgttatgtggctggactttgtcacatacttgcatcaccatggtcatcatcagaaactgccttggtatcgcggcaaggtaacaaaaataaatagaaaatagtgagtgaacacttaaatgttagatactaccttcttcttcttttttttttttttttgaggttaatgctagataatagctagaaagagaaagaaagacaaatataggtaaaaataaataatataacctgggaagaagaaaacataaaaaaagaaataatagagtctacgtaatgtttggatttttgagtgaaatggtgttcacctaccattactcaaagattctgttgtctacgtagtgtttggactttggagtgaaatggtgttcacctaccattactcagattctgttgtgtcccttagttactgtcttatattcttagggtatattctttattttacatccttttcacatcttacttgaaaagatttttaattattcattgaaatattaacgtgacagttaaattaaaataataaaaaattcgttaaaacttcaaataaataagagtgaaaggatcatcatttttcttctttcttttattgcgttattaatcatgcttctcttcttttttttcttcgctttccacccatatcaaattcatgtgaagtatgagaaaatcacgattcaatggaaagctacaggaactttttttgttttgtttttataatcggaattaatttatactccattttttcacaataaatgttacttagtgccttaaagataatatttgaaaaattaaaaaaattattaatacactgtactactatataatatttgacatatatttaacatgattttctattgaaaatttgtatttattattttttaatcaaaacccataaggcattaatttacaagacccatttttcatttatagctttacctgtgatcatttatagctttaagggacttagatgttacaatcttaattacaagtaaatatttatgaaaaacatgtgtcttaccccttaaccttacctcaacaaagaaagtgtgataagtggcaacacacgtgttgcttttttggcccagcaataacacgtgtttttgtggtgtacaaaaatggacaggaatggagttatttaagaggtggtctcacaactgtggatcgtgactatggttggatcaataacattcaccatgacattggcacccatgttattcaccatcttttccctcaaattcctcattatcacctcgttgaagcggtatattttactattattactcacctaaaaagaatgcaattagtacatttgttttatctcttggaagttagtcattttcagttgcatgattgtaatgttctctctatttttaaaccatgttttcacacctacttcgtttaaaataagaatgtggatactattctaatttctattaacttcttttaaaaaataatgtaaaactagtattaaaaaagaggaaatagattacactctactaatactaatagtataaaaaaaattacattgttattttatcacaaataattatatataattaatttttacaatcattatcttaaaagtcatgtatgatatacagtttttacatgctttggtacttattgtaaagttagtgatttattcattatttatgttatataattggcataaatatcatgtaaccagctcactatactataatgggaacttggtggtgaaaggggtttacaaccctcttttctaggtgtaggtgctttgatacttctggtccctttttatatcaatataaattatattttgctgataaaaaaaacattattaatatataatcattaacttctttaaaaaccgtacctaaaactttatattattaaaaagaagattgagatcagcaaaagaaaaaaaaattaacagtcatttgaattcactgcagacacaagcagcaaaatcagttcttggagagtattaccgtgagccagaaagatctgcaccattaccatttcatctaataaagtatttaattcagagtatgagacaagaccacttcgtaagtgacactggagatgtggtttattatcagactgattctctgcaccttcactcgcaccgagactga

SEQ ID NO: 74 - DNA, 3825 bp, Artificial
  Gm183-6 FAD3A Allele #6 (SEQ ID NO:74)
atggttaaagacacaaagcctttagcctatgctgctaataatggataccaaaaggaagcttttgatcccagtgctcctccaccgtttaagattgcagaaatcagagttgcaataccaaaacattgctgggtcaagaatccatggagatccctcagttatgttctcagggatgtgcttgtaattgctgcattgatggctgctgcaagtcacttcaacaactggcttctctggctaatctattggcccattcaaggaacaatgttctgggctctgtttgttcttggacatgattggtaattaattaatttgttgttacttttttgttataatatgaatctcacacactgctttgttatgcctacctcatttcatttggctttagacaacttaaatttgagatctttattatgttttttgcttatatggtaaagtgattcattcttcacattgaattgaacagtggccatggaagcttttcagacagcccttttctaaataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaaggaatctttatacttcagataaagctgttcttgaacatttttttttgtcattatcttagttaaccgagaagatttacaagaatctagacaacatgacaagacttgttagattcactgtgccatttccattgtttgtgtatccaatttatttggtgagtgcttttttttttttacttggaagactacaacacattattattattataatatggttcaaatcaatgacttttaatttctttgtgatgtgcactccattttcagttctcaagaagccccggaaaggaaggttctcacttcaatccctacagcaatctgttcccacccagtgagagaaagggaatagcaatatcaacactgtgttgggttaccatgttttctatgcttatctatctctccttcataactagtccagttctattgctcaagctctatggaattccatattgggtaattaaattactcttacattactttttcctctttttttttatgggtcttaactagtatcacaaaaatattggttaaaaaattttaaaaaaatatttattatgtaaatcataaaagaacataaaaaaaatgatgaataacataattttcgtctcttattaaaaatatttttattttaaatttcttaatcaatatatttagaatctggttaacattttttgaatatttcaattctccaattaaaaatttgaaatagtcaccattaattatgtaattgtttgaacacgtgcagatatttgttatgtggctggactttgtcacatacttgcatcaccatggtcatcatcagaaactgccttggtatcgcggcaaggtaacaaaaataaatagaaaatagtgagtgaacacttaaatgttagatactaccttcttcttcttttttttttttttttgaggttaatgctagataatagctagaaagagaaagaaagacaaatataggtaaaaataaataatataacctgggaagaagaaaacataaaaaaagaaataatagagtctacgtaatgtttggatttttgagtgaaatggtgttcacctaccattactcaaagattctgttgtctacgtagtgtttggactttggagtgaaatggtgttcacctaccattactcagattctgttgtgtcccttagttactgtcttatattcttagggtatattctttattttacatccttttcacatcttacttgaaaagatttttaattattcattgaaatattaacgtgacagttaaattaaaataataaaaaattcgttaaaacttcaaataaataagagtgaaaggatcatcatttttcttctttcttttattgcgttattaatcatgcttctcttcttttttttcttcgctttccacccatatcaaattcatgtgaagtatgagaaaatcacgattcaatggaaagctacaggaactttttttgttttgtttttataatcggaattaatttatactccattttttcacaataaatgttacttagtgccttaaagataatatttgaaaaattaaaaaaattattaatacactgtactactatataatatttgacatatatttaacatgattttctattgaaaatttgtatttattattttttaatcaaaacccataaggcattaatttacaagacccatttttcatttatagctttacctgtgatcatttatagctttaagggacttagatgttacaatcttaattacaagtaaatatttatgaaaaacatgtgtcttaccccttaaccttacctcaacaaagaaagtgtgataagtggcaacacacgtgttgcttttttggcccagcaataacacgtgtttttgtggtgtacaaaaatggacaggaatggagttatttaagaggtggtctcacaactgtggatcgtgactatggttggatcaataacattcaccatgacattggcacccatgttattcaccatcttttccctcaaattcctcattatcacctcgttgaagcggtatattttactattattactcacctaaaaagaatgcaattagtacatttgttttatctcttggaagttagtcattttcagttgcatgattgtaatgttctctctatttttaaaccatgttttcacacctacttcgtttaaaataagaatgtggatactattctaatttctattaacttcttttaaaaaataatgtaaaactagtattaaaaaagaggaaatagattacactctactaatactaatagtataaaaaaaattacattgttattttatcacaaataattatatataattaatttttacaatcattatcttaaaagtcatgtatgatatacagtttttacatgctttggtacttattgtaaagttagtgatttattcattatttatgttatataattggcataaatatcatgtaaccagctcactatactataatgggaacttggtggtgaaaggggtttacaaccctcttttctaggtgtaggtgctttgatacttctggtccctttttatatcaatataaattatattttgctgataaaaaaaacattattaatatataatcattaacttctttaaaaaccgtacctaaaactttatattattaaaaagaagattgagatcagcaaaagaaaaaaaaattaacagtcatttgaattcactgcagacacaagcagcaaaatcagttcttggagagtattaccgtgagccagaaagatctgcaccattaccatttcatctaataaagtatttaattcagagtatgagacaagaccacttcgtaagtgacactggagatgtggtttattatcagactgattctctgcaccttcactcgcaccgagactga

SEQ ID NO: 75 - DNA, 3861 bp, Artificial; identical to SEQ ID NO: 68
  Gm183-7 FAD3A Allele #1 (SEQ ID NO:75)

SEQ ID NO: 76 - DNA, 3794 bp, Artificial
  Gm183-7 FAD3A Allele #2 (SEQ ID NO:76)
atggttaaagacacaaagcctttagcctatgctgctaataatggataccaaaaggaagcttttgatcccagtgctcctccaccgtttaagattgcagaaatcagagttgcaataccaaaacattgctgggtcaagaatccatggagatccctcagttatgttctcagggatgtgcttgtaattgctgcattgatggctgctgcaagtcacttcaacaactggcttctctggctaatctattggcccattcaaggaacaatgttctgggctctgtttgttcttggacatgattggtaattaattaatttgttgttacttttttgttataatatgaatctcacacactgctttgttatgcctacctcatttcatttggctttagacaacttaaatttgagatctttattatgttttttgcttatatggtaaagtgattcattcttcacattgaattgaacagtggcataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaaggaatctttatacttcagataaagctgttcttgaacatttttttttgtcattatcttagttaaccgagaagatttacaagaatctagacaacatgacaagacttgttagattcactgtgccatttccattgtttgtgtatccaatttatttggtgagtgcttttttttttttacttggaagactacaacacattattattattataatatggttcaaatcaatgacttttaatttctttgtgatgtgcactccattttcagttctcaagaagccccggaaaggaaggttctcacttcaatccctacagcaatctgttcccacccagtgagagaaagggaatagcaatatcaacactgtgttgggttaccatgttttctatgcttatctatctctccttcataactagtccagttctattgctcaagctctatggaattccatattgggtaattaaattactcttacattactttttcctctttttttttatgggtcttaactagtatcacaaaaatattggttaaaaaattttaaaaaaatatttattatgtaaatcataaaagaacataaaaaaaatgatgaataacataattttcgtctcttattaaaaatatttttattttaaatttcttaatcaatatatttagaatctggttaacattttttgaatatttcaattctccaattaaaaatttgaaatagtcaccattaattatgtaattgtttgaacacgtgcagatatttgttatgtggctggactttgtcacatacttgcatcaccatggtcatcatcagaaactgccttggtatcgcggcaaggtaacaaaaataaatagaaaatagtgagtgaacacttaaatgttagatactaccttcttcttcttttttttttttttttgaggttaatgctagataatagctagaaagagaaagaaagacaaatataggtaaaaataaataatataacctgggaagaagaaaacataaaaaaagaaataatagagtctacgtaatgtttggatttttgagtgaaatggtgttcacctaccattactcaaagattctgttgtctacgtagtgtttggactttggagtgaaatggtgttcacctaccattactcagattctgttgtgtcccttagttactgtcttatattcttagggtatattctttattttacatccttttcacatcttacttgaaaagatttttaattattcattgaaatattaacgtgacagttaaattaaaataataaaaaattcgttaaaacttcaaataaataagagtgaaaggatcatcatttttcttctttcttttattgcgttattaatcatgcttctcttcttttttttcttcgctttccacccatatcaaattcatgtgaagtatgagaaaatcacgattcaatggaaagctacaggaactttttttgttttgtttttataatcggaattaatttatactccattttttcacaataaatgttacttagtgccttaaagataatatttgaaaaattaaaaaaattattaatacactgtactactatataatatttgacatatatttaacatgattttctattgaaaatttgtatttattattttttaatcaaaacccataaggcattaatttacaagacccatttttcatttatagctttacctgtgatcatttatagctttaagggacttagatgttacaatcttaattacaagtaaatatttatgaaaaacatgtgtcttaccccttaaccttacctcaacaaagaaagtgtgataagtggcaacacacgtgttgcttttttggcccagcaataacacgtgtttttgtggtgtacaaaaatggacaggaatggagttatttaagaggtggtctcacaactgtggatcgtgactatggttggatcaataacattcaccatgacattggcacccatgttattcaccatcttttccctcaaattcctcattatcacctcgttgaagcggtatattttactattattactcacctaaaaagaatgcaattagtacatttgttttatctcttggaagttagtcattttcagttgcatgattgtaatgttctctctatttttaaaccatgttttcacacctacttcgtttaaaataagaatgtggatactattctaatttctattaacttcttttaaaaaataatgtaaaactagtattaaaaaagaggaaatagattacactctactaatactaatagtataaaaaaaattacattgttattttatcacaaataattatatataattaatttttacaatcattatcttaaaagtcatgtatgatatacagtttttacatgctttggtacttattgtaaagttagtgatttattcattatttatgttatataattggcataaatatcatgtaaccagctcactatactataatgggaacttggtggtgaaaggggtttacaaccctcttttctaggtgtaggtgctttgatacttctggtccctttttatatcaatataaattatattttgctgataaaaaaaacattattaatatataatcattaacttctttaaaaaccgtacctaaaactttatattattaaaaagaagattgagatcagcaaaagaaaaaaaaattaacagtcatttgaattcactgcagacacaagcagcaaaatcagttcttggagagtattaccgtgagccagaaagatctgcaccattaccatttcatctaataaagtatttaattcagagtatgagacaagaccacttcgtaagtgacactggagatgtggtttattatcagactgattctctgcaccttcactcgcaccgagactga

SEQ ID NO: 77 - DNA, 3859 bp, Artificial
  Gm183-8 FAD3A Allele #1 (SEQ ID NO:77)
atggttaaagacacaaagcctttagcctatgctgctaataatggataccaaaaggaagcttttgatcccagtgctcctccaccgtttaagattgcagaaatcagagttgcaataccaaaacattgctgggtcaagaatccatggagatccctcagttatgttctcagggatgtgcttgtaattgctgcattgatggctgctgcaagtcacttcaacaactggcttctctggctaatctattggcccattcaaggaacaatgttctgggctctgtttgttcttggacatgattggtaattaattaatttgttgttacttttttgttataatatgaatctcacacactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaaggaatctttatacttcagataaagctgttcttgaacatttttttttgtcattatcttagttaaccgagaagatttacaagaatctagacaacatgacaagacttgttagattcactgtgccatttccattgtttgtgtatccaatttatttggtgagtgcttttttttttttacttggaagactacaacacattattattattataatatggttcaaatcaatgacttttaatttctttgtgatgtgcactccattttcagttctcaagaagccccggaaaggaaggttctcacttcaatccctacagcaatctgttcccacccagtgagagaaagggaatagcaatatcaacactgtgttgggttaccatgttttctatgcttatctatctctccttcataactagtccagttctattgctcaagctctatggaattccatattgggtaattaaattactcttacattactttttcctctttttttttatgggtcttaactagtatcacaaaaatattggttaaaaaattttaaaaaaatatttattatgtaaatcataaaagaacataaaaaaaatgatgaataacataattttcgtctcttattaaaaatatttttattttaaatttcttaatcaatatatttagaatctggttaacattttttgaatatttcaattctccaattaaaaatttgaaatagtcaccattaattatgtaattgtttgaacacgtgcagatatttgttatgtggctggactttgtcacatacttgcatcaccatggtcatcatcagaaactgccttggtatcgcggcaaggtaacaaaaataaatagaaaatagtgagtgaacacttaaatgttagatactaccttcttcttcttttttttttttttttgaggttaatgctagataatagctagaaagagaaagaaagacaaatataggtaaaaataaataatataacctgggaagaagaaaacataaaaaaagaaataatagagtctacgtaatgtttggatttttgagtgaaatggtgttcacctaccattactcaaagattctgttgtctacgtagtgtttggactttggagtgaaatggtgttcacctaccattactcagattctgttgtgtcccttagttactgtcttatattcttagggtatattctttattttacatccttttcacatcttacttgaaaagatttttaattattcattgaaatattaacgtgacagttaaattaaaataataaaaaattcgttaaaacttcaaataaataagagtgaaaggatcatcatttttcttctttcttttattgcgttattaatcatgcttctcttcttttttttcttcgctttccacccatatcaaattcatgtgaagtatgagaaaatcacgattcaatggaaagctacaggaactttttttgttttgtttttataatcggaattaatttatactccattttttcacaataaatgttacttagtgccttaaagataatatttgaaaaattaaaaaaattattaatacactgtactactatataatatttgacatatatttaacatgattttctattgaaaatttgtatttattattttttaatcaaaacccataaggcattaatttacaagacccatttttcatttatagctttacctgtgatcatttatagctttaagggacttagatgttacaatcttaattacaagtaaatatttatgaaaaacatgtgtcttaccccttaaccttacctcaacaaagaaagtgtgataagtggcaacacacgtgttgcttttttggcccagcaataacacgtgtttttgtggtgtacaaaaatggacaggaatggagttatttaagaggtggtctcacaactgtggatcgtgactatggttggatcaataacattcaccatgacattggcacccatgttattcaccatcttttccctcaaattcctcattatcacctcgttgaagcggtatattttactattattactcacctaaaaagaatgcaattagtacatttgttttatctcttggaagttagtcattttcagttgcatgattgtaatgttctctctatttttaaaccatgttttcacacctacttcgtttaaaataagaatgtggatactattctaatttctattaacttcttttaaaaaataatgtaaaactagtattaaaaaagaggaaatagattacactctactaatactaatagtataaaaaaaattacattgttattttatcacaaataattatatataattaatttttacaatcattatcttaaaagtcatgtatgatatacagtttttacatgctttggtacttattgtaaagttagtgatttattcattatttatgttatataattggcataaatatcatgtaaccagctcactatactataatgggaacttggtggtgaaaggggtttacaaccctcttttctaggtgtaggtgctttgatacttctggtccctttttatatcaatataaattatattttgctgataaaaaaaacattattaatatataatcattaacttctttaaaaaccgtacctaaaactttatattattaaaaagaagattgagatcagcaaaagaaaaaaaaattaacagtcatttgaattcactgcagacacaagcagcaaaatcagttcttggagagtattaccgtgagccagaaagatctgcaccattaccatttcatctaataaagtatttaattcagagtatgagacaagaccacttcgtaagtgacactggagatgtggtttattatcagactgattctctgcaccttcactcgcaccgagactga

SEQ ID NO: 78 - DNA, 3829 bp, Artificial
  Gm183-8 FAD3A Allele #2 (SEQ ID NO:78)
atggttaaagacacaaagcctttagcctatgctgctaataatggataccaaaaggaagcttttgatcccagtgctcctccaccgtttaagattgcagaaatcagagttgcaataccaaaacattgctgggtcaagaatccatggagatccctcagttatgttctcagggatgtgcttgtaattgctgcattgatggctgctgcaagtcacttcaacaactggcttctctggctaatctattggcccattcaaggaacaatgttctgggctctgtttgttcttggacatgattggtaattaattaatttgttgttacttttttgttataatatgaatctcacacactgctttgttatgcctacctcatttcatttggctttagacaacttaaatttgagatctttattatgttttttgcttatatggtaaagtgattcattcttcacattgaattgaacagtggccatggaagcttttcagacagcccttttcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaaggaatctttatacttcagataaagctgttcttgaacatttttttttgtcattatcttagttaaccgagaagatttacaagaatctagacaacatgacaagacttgttagattcactgtgccatttccattgtttgtgtatccaatttatttggtgagtgcttttttttttttacttggaagactacaacacattattattattataatatggttcaaatcaatgacttttaatttctttgtgatgtgcactccattttcagttctcaagaagccccggaaaggaaggttctcacttcaatccctacagcaatctgttcccacccagtgagagaaagggaatagcaatatcaacactgtgttgggttaccatgttttctatgcttatctatctctccttcataactagtccagttctattgctcaagctctatggaattccatattgggtaattaaattactcttacattactttttcctctttttttttatgggtcttaactagtatcacaaaaatattggttaaaaaattttaaaaaaatatttattatgtaaatcataaaagaacataaaaaaaatgatgaataacataattttcgtctcttattaaaaatatttttattttaaatttcttaatcaatatatttagaatctggttaacattttttgaatatttcaattctccaattaaaaatttgaaatagtcaccattaattatgtaattgtttgaacacgtgcagatatttgttatgtggctggactttgtcacatacttgcatcaccatggtcatcatcagaaactgccttggtatcgcggcaaggtaacaaaaataaatagaaaatagtgagtgaacacttaaatgttagatactaccttcttcttcttttttttttttttttgaggttaatgctagataatagctagaaagagaaagaaagacaaatataggtaaaaataaataatataacctgggaagaagaaaacataaaaaaagaaataatagagtctacgtaatgtttggatttttgagtgaaatggtgttcacctaccattactcaaagattctgttgtctacgtagtgtttggactttggagtgaaatggtgttcacctaccattactcagattctgttgtgtcccttagttactgtcttatattcttagggtatattctttattttacatccttttcacatcttacttgaaaagatttttaattattcattgaaatattaacgtgacagttaaattaaaataataaaaaattcgttaaaacttcaaataaataagagtgaaaggatcatcatttttcttctttcttttattgcgttattaatcatgcttctcttcttttttttcttcgctttccacccatatcaaattcatgtgaagtatgagaaaatcacgattcaatggaaagctacaggaactttttttgttttgtttttataatcggaattaatttatactccattttttcacaataaatgttacttagtgccttaaagataatatttgaaaaattaaaaaaattattaatacactgtactactatataatatttgacatatatttaacatgattttctattgaaaatttgtatttattattttttaatcaaaacccataaggcattaatttacaagacccatttttcatttatagctttacctgtgatcatttatagctttaagggacttagatgttacaatcttaattacaagtaaatatttatgaaaaacatgtgtcttaccccttaaccttacctcaacaaagaaagtgtgataagtggcaacacacgtgttgcttttttggcccagcaataacacgtgtttttgtggtgtacaaaaatggacaggaatggagttatttaagaggtggtctcacaactgtggatcgtgactatggttggatcaataacattcaccatgacattggcacccatgttattcaccatcttttccctcaaattcctcattatcacctcgttgaagcggtatattttactattattactcacctaaaaagaatgcaattagtacatttgttttatctcttggaagttagtcattttcagttgcatgattgtaatgttctctctatttttaaaccatgttttcacacctacttcgtttaaaataagaatgtggatactattctaatttctattaacttcttttaaaaaataatgtaaaactagtattaaaaaagaggaaatagattacactctactaatactaatagtataaaaaaaattacattgttattttatcacaaataattatatataattaatttttacaatcattatcttaaaagtcatgtatgatatacagtttttacatgctttggtacttattgtaaagttagtgatttattcattatttatgttatataattggcataaatatcatgtaaccagctcactatactataatgggaacttggtggtgaaaggggtttacaaccctcttttctaggtgtaggtgctttgatacttctggtccctttttatatcaatataaattatattttgctgataaaaaaaacattattaatatataatcattaacttctttaaaaaccgtacctaaaactttatattattaaaaagaagattgagatcagcaaaagaaaaaaaaattaacagtcatttgaattcactgcagacacaagcagcaaaatcagttcttggagagtattaccgtgagccagaaagatctgcaccattaccatttcatctaataaagtatttaattcagagtatgagacaagaccacttcgtaagtgacactggagatgtggtttattatcagactgattctctgcaccttcactcgcaccgagactga

SEQ ID NO: 79 - DNA, 3861 bp, Artificial; identical to SEQ ID NO: 71
  Gm183-8 FAD3A Allele #3 (SEQ ID NO:79)

SEQ ID NO: 80 - DNA, 3863 bp, Artificial
  Gm184-1 FAD3A Allele #1 (SEQ ID NO:80)
atggttaaagacacaaagcctttagcctatgctgctaataatggataccaaaaggaagcttttgatcccagtgctcctccaccgtttaagattgcagaaatcagagttgcaataccaaaacattgctgggtcaagaatccatggagatccctcagttatgttctcagggatgtgcttgtaattgctgcattgatggctgctgcaagtcacttcaacaactggcttctctggctaatctattggcccattcaaggaacaatgttctgggctctgtttgttcttggacatgattggtaattaattaatttgttgttacttttttgttataatatgaatctcacacactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagccgggatgaactaaccgtcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaaggaatctttatacttcagataaagctgttcttgaacatttttttttgtcattatcttagttaaccgagaagatttacaagaatctagacaacatgacaagacttgttagattcactgtgccatttccattgtttgtgtatccaatttatttggtgagtgcttttttttttttacttggaagactacaacacattattattattataatatggttcaaatcaatgacttttaatttctttgtgatgtgcactccattttcagttctcaagaagccccggaaaggaaggttctcacttcaatccctacagcaatctgttcccacccagtgagagaaagggaatagcaatatcaacactgtgttgggttaccatgttttctatgcttatctatctctccttcataactagtccagttctattgctcaagctctatggaattccatattgggtaattaaattactcttacattactttttcctctttttttttatgggtcttaactagtatcacaaaaatattggttaaaaaattttaaaaaaatatttattatgtaaatcataaaagaacataaaaaaaatgatgaataacataattttcgtctcttattaaaaatatttttattttaaatttcttaatcaatatatttagaatctggttaacattttttgaatatttcaattctccaattaaaaatttgaaatagtcaccattaattatgtaattgtttgaacacgtgcagatatttgttatgtggctggactttgtcacatacttgcatcaccatggtcatcatcagaaactgccttggtatcgcggcaaggtaacaaaaataaatagaaaatagtgagtgaacacttaaatgttagatactaccttcttcttcttttttttttttttttgaggttaatgctagataatagctagaaagagaaagaaagacaaatataggtaaaaataaataatataacctgggaagaagaaaacataaaaaaagaaataatagagtctacgtaatgtttggatttttgagtgaaatggtgttcacctaccattactcaaagattctgttgtctacgtagtgtttggactttggagtgaaatggtgttcacctaccattactcagattctgttgtgtcccttagttactgtcttatattcttagggtatattctttattttacatccttttcacatcttacttgaaaagatttttaattattcattgaaatattaacgtgacagttaaattaaaataataaaaaattcgttaaaacttcaaataaataagagtgaaaggatcatcatttttcttctttcttttattgcgttattaatcatgcttctcttcttttttttcttcgctttccacccatatcaaattcatgtgaagtatgagaaaatcacgattcaatggaaagctacaggaactttttttgttttgtttttataatcggaattaatttatactccattttttcacaataaatgttacttagtgccttaaagataatatttgaaaaattaaaaaaattattaatacactgtactactatataatatttgacatatatttaacatgattttctattgaaaatttgtatttattattttttaatcaaaacccataaggcattaatttacaagacccatttttcatttatagctttacctgtgatcatttatagctttaagggacttagatgttacaatcttaattacaagtaaatatttatgaaaaacatgtgtcttaccccttaaccttacctcaacaaagaaagtgtgataagtggcaacacacgtgttgcttttttggcccagcaataacacgtgtttttgtggtgtacaaaaatggacaggaatggagttatttaagaggtggtctcacaactgtggatcgtgactatggttggatcaataacattcaccatgacattggcacccatgttattcaccatcttttccctcaaattcctcattatcacctcgttgaagcggtatattttactattattactcacctaaaaagaatgcaattagtacatttgttttatctcttggaagttagtcattttcagttgcatgattgtaatgttctctctatttttaaaccatgttttcacacctacttcgtttaaaataagaatgtggatactattctaatttctattaacttcttttaaaaaataatgtaaaactagtattaaaaaagaggaaatagattacactctactaatactaatagtataaaaaaaattacattgttattttatcacaaataattatatataattaatttttacaatcattatcttaaaagtcatgtatgatatacagtttttacatgctttggtacttattgtaaagttagtgatttattcattatttatgttatataattggcataaatatcatgtaaccagctcactatactataatgggaacttggtggtgaaaggggtttacaaccctcttttctaggtgtaggtgctttgatacttctggtccctttttatatcaatataaattatattttgctgataaaaaaaacattattaatatataatcattaacttctttaaaaaccgtacctaaaactttatattattaaaaagaagattgagatcagcaaaagaaaaaaaaattaacagtcatttgaattcactgcagacacaagcagcaaaatcagttcttggagagtattaccgtgagccagaaagatctgcaccattaccatttcatctaataaagtatttaattcagagtatgagacaagaccacttcgtaagtgacactggagatgtggtttattatcagactgattctctgcaccttcactcgcaccgagactga

SEQ ID NO: 81 - DNA, 3863 bp, Artificial
  Gm184-2 FAD3A Allele #1 (SEQ ID NO:81)
atggttaaagacacaaagcctttagcctatgctgctaataatggataccaaaaggaagcttttgatcccagtgctcctccaccgtttaagattgcagaaatcagagttgcaataccaaaacattgctgggtcaagaatccatggagatccctcagttatgttctcagggatgtgcttgtaattgctgcattgatggctgctgcaagtcacttcaacaactggcttctctggctaatctattggcccattcaaggaacaatgttctgggctctgtttgttcttggacatgattggtaattaattaatttgttgttacttttttgttataatatgaatctcacacactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaaggaatctttatacttcagataaagctgttcttgaacatttttttttgtcattatcttagttaaccgagaagatttacaagaatctagacaacatgacaagacttgttagattcactgtgccatttccattgtttgtgtatccaatttatttggtgagtgcttttttttttttacttggaagactacaacacattattattattataatatggttcaaatcaatgacttttaatttctttgtgatgtgcactccattttcagttctcaagaagccccggaaaggaaggttctcacttcaatccctacagcaatctgttcccacccagtgagagaaagggaatagcaatatcaacactgtgttgggttaccatgttttctatgcttatctatctctccttcataactagtccagttctattgctcaagctctatggaattccatattgggtaattaaattactcttacattactttttcctctttttttttatgggtcttaactagtatcacaaaaatattggttaaaaaattttaaaaaaatatttattatgtaaatcataaaagaacataaaaaaaatgatgaataacataattttcgtctcttattaaaaatatttttattttaaatttcttaatcaatatatttagaatctggttaacattttttgaatatttcaattctccaattaaaaatttgaaatagtcaccattaattatgtaattgtttgaacacgtgcagatatttgttatgtggctggactttgtcacatacttgcatcaccatggtcatcatcagaaactgccttggtatcgcggcaaggtaacaaaaataaatagaaaatagtgagtgaacacttaaatgttagatactaccttcttcttcttttttttttttttttgaggttaatgctagataatagctagaaagagaaagaaagacaaatataggtaaaaataaataatataacctgggaagaagaaaacataaaaaaagaaataatagagtctacgtaatgtttggatttttgagtgaaatggtgttcacctaccattactcaaagattctgttgtctacgtagtgtttggactttggagtgaaatggtgttcacctaccattactcagattctgttgtgtcccttagttactgtcttatattcttagggtatattctttattttacatccttttcacatcttacttgaaaagatttttaattattcattgaaatattaacgtgacagttaaattaaaataataaaaaattcgttaaaacttcaaataaataagagtgaaaggatcatcatttttcttctttcttttattgcgttattaatcatgcttctcttcttttttttcttcgctttccacccatatcaaattcatgtgaagtatgagaaaatcacgattcaatggaaagctacaggaactttttttgttttgtttttataatcggaattaatttatactccattttttcacaataaatgttacttagtgccttaaagataatatttgaaaaattaaaaaaattattaatacactgtactactatataatatttgacatatatttaacatgattttctattgaaaatttgtatttattattttttaatcaaaacccataaggcattaatttacaagacccatttttcatttatagctttacctgtgatcatttatagctttaagggacttagatgttacaatcttaattacaagtaaatatttatgaaaaacatgtgtcttaccccttaaccttacctcaacaaagaaagtgtgataagtggcaacacacgtgttgcttttttggcccagcaataacacgtgtttttgtggtgtacaaaaatggacaggaatggagttatttaagaggtggtctcacaactgtggatcgtgactatggttggatcaataacattcaccatgacattggcacccatgttattcaccatcttttccctcaaattcctcattatcacctcgttgaagcggtatattttactattattactcacctaaaaagaatgcaattagtacatttgttttatctcttggaagttagtcattttcagttgcatgattgtaatgttctctctatttttaaaccatgttttcacacctacttcgtttaaaataagaatgtggatactattctaatttctattaacttcttttaaaaaataatgtaaaactagtattaaaaaagaggaaatagattacactctactaatactaatagtataaaaaaaattacattgttattttatcacaaataattatatataattaatttttacaatcattatcttaaaagtcatgtatgatatacagtttttacatgctttggtacttattgtaaagttagtgatttattcattatttatgttatataattggcataaatatcatgtaaccagctcactatactataatgggaacttggtggtgaaaggggtttacaaccctcttttctaggtgtaggtgctttgatacttctggtccctttttatatcaatataaattatattttgctgataaaaaaaacattattaatatataatcattaacttctttaaaaaccgtacctaaaactttatattattaaaaagaagattgagatcagcaaaagaaaaaaaaattaacagtcatttgaattcactgcagacacaagcagcaaaatcagttcttggagagtattaccgtgagccagaaagatctgcaccattaccatttcatctaataaagtatttaattcagagtatgagacaagaccacttcgtaagtgacactggagatgtggtttattatcagactgattctctgcaccttcactcgcaccgagactga

SEQ ID NO: 82 - DNA, 3732 bp, Artificial
  Gm184-2 FAD3A Allele #2 (SEQ ID NO:82)
atggttaaagacacaaagcctttagcctatgctgctaataatggataccaaaaggaagcttttgatcccagtgctcctccaccgtttaagattgcagaaatcagagttgcaataccaaaacattgctgggtcaagaatccatggagatccctcagttatgttctcagggatgtgcttgtaattgctgcattgatggctgctgcaagtcacttcaacaactggcttctctggctaatctattggcccattcaaggaacaatgttctgggctctgtttgttcttggacatgattggtaattaattaatttgttgttacttttttgttataatatgaatctcacacactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaaggaatctttatacttcagataaagctgttcttgaacatttttttttgtcattatcttagttaaccgagaagatttacaagaatctagacaacatgacaagacttgttagattcactgtgccatttccattgtttgtgtatccaatttatttggtgagtgcttttttttttttacttggaagactacaacacattattattattataatatggttcaaatcaatgacttttaatttctttgtgatgtgcactccattttcagttctcaagaagccccggaaaggaaggttctcacttcaatccctacagcaatctgttcccacccagtgagagaaagggaatagcaatatcaacactgtgttgggttaccatgttttctatgcttatctatctctccttcataactagtccagttctattgctcaagctctatggaattccatattgggtaattaaattactcttacattactttttcctctttttttttatgggtcttaactagtatcacaaaaatattggttaaaaaattttaaaaaaatatttattatgtaaatcataaaagaacataaaaaaaatgatgaataacataattttcgtctcttattaaaaatatttttattttaaatttcttaatcaatatatttagaatctggttaacattttttgaatatttcaattctccaattaaaaatttgaaatagtcaccattaattatgtaattgtttgaacacgtgcagatatttgttatgtggctggactttgtcacatacttgcatcaccatggtcatcatcagaaactgccttggtatcgcggcaaggtaacaaaaataaatagaaaatagtgagtgaacacttaaatgttagatactaccttcttcttcttttttttttttttttgaggttaatgctagataatagctagaaagagaaagaaagacaaatataggtaaaaataaataatataacctgggaagaagaaaacataaaaaaagaaataatagagtctacgtaatgtttggatttttgagtgaaatggtgttcacctaccattactcaaagattctgttgtctacgtagtgtttggactttggagtgaaatggtgttcacctaccattactcagattctgttgtgtcccttagttactgtcttatattcttagggtatattctttattttacatccttttcacatcttacttgaaaagatttttaattattcattgaaatattaacgtgacagttaaattaaaataataaaaaattcgttaaaacttcaaataaataagagtgaaaggatcatcatttttcttctttcttttattgcgttattaatcatgcttctcttcttttttttcttcgctttccacccatatcaaattcatgtgaagtatgagaaaatcacgattcaatggaaagctacaggaactttttttgttttgtttttataatcggaattaatttatactccattttttcacaataaatgttacttagtgccttaaagataatatttgaaaaattaaaaaaattattaatacactgtactactatataatatttgacatatatttaacatgattttctattgaaaatttgtatttattattttttaatcaaaacccataaggcattaatttacaagacccatttttcatttatagctttacctgtgatcatttatagctttaagggacttagatgttacaatcttaattacaagtaaatatttatgaaaaacatgtgtcttaccccttaaccttacctcaacaaagaaagtgtgataagtggcaacacacgtgttgcttttttggcccagcaataacacgtgtttttgtggtgtacaaaaatggacaggaatggagttatttaagaggtggtctcacaactgtggatcgtgactatggttggatcaataacattcaccatgacattggcacccatgttattcaccatcttttccctcaaattcctcattatcacctcgttgaagcggtatattttactattattactcacctaaaaagaatgcaattagtacatttgttttatctcttggaagttagtcattttcagttgcatgattgtaatgttctctctatttttaaaccatgttttcacacctacttcgtttaaaataagaatgtggatactattctaatttctattaacttcttttaaaaaataatgtaaaactagtattaaaaaagaggaaatagattacactctactaatactaatagtataaaaaaaattacattgttattttatcacaaataattatatataattaatttttacaatcattatcttaaaagtcatgtatgatatacagtttttacatgctttggtacttattgtaaagttagtgatttattcattatttatgttatataattggcataaatatcatgtaaccagctcactatactataatgggaacttggtggtgaaaggggtttacaaccctcttttctaggtgtaggtgctttgatacttctggtccctttttatatcaatataaattatattttgctgataaaaaaaacattattaatatataatcattaacttctttaaaaaccgtacctaaaactttatattattaaaaagaagattgagatcagcaaaagaaaaaaaaattaacagtcatttgaattcactgcagacacaagcagcaaaatcagttcttggagagtattaccgtgagccagaaagatctgcaccattaccatttcatctaataaagtatttaattcagagtatgagacaagaccacttcgtaagtgacactggagatgtggtttattatcagactgattctctgcaccttcactcgcaccgagactga

SEQ ID NO: 83 - DNA, 3864 bp, Artificial; identical to SEQ ID NO: 67
  Gm184-4 FAD3A Allele #1 (SEQ ID NO:83)

SEQ ID NO: 84 - DNA, 3862 bp, Artificial; identical to SEQ ID NO: 69
  Gm184-4 FAD3A Allele #2 (SEQ ID NO:84)

SEQ ID NO: 85 - DNA, 3856 bp, Artificial
  Gm184-5 FAD3A Allele #1 (SEQ ID NO:85)
atggttaaagacacaaagcctttagcctatgctgctaataatggataccaaaaggaagcttttgatcccagtgctcctccaccgtttaagattgcagaaatcagagttgcaataccaaaacattgctgggtcaagaatccatggagatccctcagttatgttctcagggatgtgcttgtaattgctgcattgatggctgctgcaagtcacttcaacaactggcttctctggctaatctattggcccattcaaggaacaatgttctgggctctgtttgttcttggacatgattggtaattaattaatttgttgttacttttttgttataatatgaatctcacacactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggttcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaaggaatctttatacttcagataaagctgttcttgaacatttttttttgtcattatcttagttaaccgagaagatttacaagaatctagacaacatgacaagacttgttagattcactgtgccatttccattgtttgtgtatccaatttatttggtgagtgcttttttttttttacttggaagactacaacacattattattattataatatggttcaaatcaatgacttttaatttctttgtgatgtgcactccattttcagttctcaagaagccccggaaaggaaggttctcacttcaatccctacagcaatctgttcccacccagtgagagaaagggaatagcaatatcaacactgtgttgggttaccatgttttctatgcttatctatctctccttcataactagtccagttctattgctcaagctctatggaattccatattgggtaattaaattactcttacattactttttcctctttttttttatgggtcttaactagtatcacaaaaatattggttaaaaaattttaaaaaaatatttattatgtaaatcataaaagaacataaaaaaaatgatgaataacataattttcgtctcttattaaaaatatttttattttaaatttcttaatcaatatatttagaatctggttaacattttttgaatatttcaattctccaattaaaaatttgaaatagtcaccattaattatgtaattgtttgaacacgtgcagatatttgttatgtggctggactttgtcacatacttgcatcaccatggtcatcatcagaaactgccttggtatcgcggcaaggtaacaaaaataaatagaaaatagtgagtgaacacttaaatgttagatactaccttcttcttcttttttttttttttttgaggttaatgctagataatagctagaaagagaaagaaagacaaatataggtaaaaataaataatataacctgggaagaagaaaacataaaaaaagaaataatagagtctacgtaatgtttggatttttgagtgaaatggtgttcacctaccattactcaaagattctgttgtctacgtagtgtttggactttggagtgaaatggtgttcacctaccattactcagattctgttgtgtcccttagttactgtcttatattcttagggtatattctttattttacatccttttcacatcttacttgaaaagatttttaattattcattgaaatattaacgtgacagttaaattaaaataataaaaaattcgttaaaacttcaaataaataagagtgaaaggatcatcatttttcttctttcttttattgcgttattaatcatgcttctcttcttttttttcttcgctttccacccatatcaaattcatgtgaagtatgagaaaatcacgattcaatggaaagctacaggaactttttttgttttgtttttataatcggaattaatttatactccattttttcacaataaatgttacttagtgccttaaagataatatttgaaaaattaaaaaaattattaatacactgtactactatataatatttgacatatatttaacatgattttctattgaaaatttgtatttattattttttaatcaaaacccataaggcattaatttacaagacccatttttcatttatagctttacctgtgatcatttatagctttaagggacttagatgttacaatcttaattacaagtaaatatttatgaaaaacatgtgtcttaccccttaaccttacctcaacaaagaaagtgtgataagtggcaacacacgtgttgcttttttggcccagcaataacacgtgtttttgtggtgtacaaaaatggacaggaatggagttatttaagaggtggtctcacaactgtggatcgtgactatggttggatcaataacattcaccatgacattggcacccatgttattcaccatcttttccctcaaattcctcattatcacctcgttgaagcggtatattttactattattactcacctaaaaagaatgcaattagtacatttgttttatctcttggaagttagtcattttcagttgcatgattgtaatgttctctctatttttaaaccatgttttcacacctacttcgtttaaaataagaatgtggatactattctaatttctattaacttcttttaaaaaataatgtaaaactagtattaaaaaagaggaaatagattacactctactaatactaatagtataaaaaaaattacattgttattttatcacaaataattatatataattaatttttacaatcattatcttaaaagtcatgtatgatatacagtttttacatgctttggtacttattgtaaagttagtgatttattcattatttatgttatataattggcataaatatcatgtaaccagctcactatactataatgggaacttggtggtgaaaggggtttacaaccctcttttctaggtgtaggtgctttgatacttctggtccctttttatatcaatataaattatattttgctgataaaaaaaacattattaatatataatcattaacttctttaaaaaccgtacctaaaactttatattattaaaaagaagattgagatcagcaaaagaaaaaaaaattaacagtcatttgaattcactgcagacacaagcagcaaaatcagttcttggagagtattaccgtgagccagaaagatctgcaccattaccatttcatctaataaagtatttaattcagagtatgagacaagaccacttcgtaagtgacactggagatgtggtttattatcagactgattctctgcaccttcactcgcaccgagactga

SEQ ID NO: 86 - DNA, 3856 bp, Artificial
  Gm184-5 FAD3A Allele #2 (SEQ ID NO:86)
atggttaaagacacaaagcctttagcctatgctgctaataatggataccaaaaggaagcttttgatcccagtgctcctccaccgtttaagattgcagaaatcagagttgcaataccaaaacattgctgggtcaagaatccatggagatccctcagttatgttctcagggatgtgcttgtaattgctgcattgatggctgctgcaagtcacttcaacaactggcttctctggctaatctattggcccattcaaggaacaatgttctgggctctgtttgttcttggacatgattggtaattaattaatttgttgttacttttttgttataatatgaatctcacacactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggatcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaaggaatctttatacttcagataaagctgttcttgaacatttttttttgtcattatcttagttaaccgagaagatttacaagaatctagacaacatgacaagacttgttagattcactgtgccatttccattgtttgtgtatccaatttatttggtgagtgcttttttttttttacttggaagactacaacacattattattattataatatggttcaaatcaatgacttttaatttctttgtgatgtgcactccattttcagttctcaagaagccccggaaaggaaggttctcacttcaatccctacagcaatctgttcccacccagtgagagaaagggaatagcaatatcaacactgtgttgggttaccatgttttctatgcttatctatctctccttcataactagtccagttctattgctcaagctctatggaattccatattgggtaattaaattactcttacattactttttcctctttttttttatgggtcttaactagtatcacaaaaatattggttaaaaaattttaaaaaaatatttattatgtaaatcataaaagaacataaaaaaaatgatgaataacataattttcgtctcttattaaaaatatttttattttaaatttcttaatcaatatatttagaatctggttaacattttttgaatatttcaattctccaattaaaaatttgaaatagtcaccattaattatgtaattgtttgaacacgtgcagatatttgttatgtggctggactttgtcacatacttgcatcaccatggtcatcatcagaaactgccttggtatcgcggcaaggtaacaaaaataaatagaaaatagtgagtgaacacttaaatgttagatactaccttcttcttcttttttttttttttttgaggttaatgctagataatagctagaaagagaaagaaagacaaatataggtaaaaataaataatataacctgggaagaagaaaacataaaaaaagaaataatagagtctacgtaatgtttggatttttgagtgaaatggtgttcacctaccattactcaaagattctgttgtctacgtagtgtttggactttggagtgaaatggtgttcacctaccattactcagattctgttgtgtcccttagttactgtcttatattcttagggtatattctttattttacatccttttcacatcttacttgaaaagatttttaattattcattgaaatattaacgtgacagttaaattaaaataataaaaaattcgttaaaacttcaaataaataagagtgaaaggatcatcatttttcttctttcttttattgcgttattaatcatgcttctcttcttttttttcttcgctttccacccatatcaaattcatgtgaagtatgagaaaatcacgattcaatggaaagctacaggaactttttttgttttgtttttataatcggaattaatttatactccattttttcacaataaatgttacttagtgccttaaagataatatttgaaaaattaaaaaaattattaatacactgtactactatataatatttgacatatatttaacatgattttctattgaaaatttgtatttattattttttaatcaaaacccataaggcattaatttacaagacccatttttcatttatagctttacctgtgatcatttatagctttaagggacttagatgttacaatcttaattacaagtaaatatttatgaaaaacatgtgtcttaccccttaaccttacctcaacaaagaaagtgtgataagtggcaacacacgtgttgcttttttggcccagcaataacacgtgtttttgtggtgtacaaaaatggacaggaatggagttatttaagaggtggtctcacaactgtggatcgtgactatggttggatcaataacattcaccatgacattggcacccatgttattcaccatcttttccctcaaattcctcattatcacctcgttgaagcggtatattttactattattactcacctaaaaagaatgcaattagtacatttgttttatctcttggaagttagtcattttcagttgcatgattgtaatgttctctctatttttaaaccatgttttcacacctacttcgtttaaaataagaatgtggatactattctaatttctattaacttcttttaaaaaataatgtaaaactagtattaaaaaagaggaaatagattacactctactaatactaatagtataaaaaaaattacattgttattttatcacaaataattatatataattaatttttacaatcattatcttaaaagtcatgtatgatatacagtttttacatgctttggtacttattgtaaagttagtgatttattcattatttatgttatataattggcataaatatcatgtaaccagctcactatactataatgggaacttggtggtgaaaggggtttacaaccctcttttctaggtgtaggtgctttgatacttctggtccctttttatatcaatataaattatattttgctgataaaaaaaacattattaatatataatcattaacttctttaaaaaccgtacctaaaactttatattattaaaaagaagattgagatcagcaaaagaaaaaaaaattaacagtcatttgaattcactgcagacacaagcagcaaaatcagttcttggagagtattaccgtgagccagaaagatctgcaccattaccatttcatctaataaagtatttaattcagagtatgagacaagaccacttcgtaagtgacactggagatgtggtttattatcagactgattctctgcaccttcactcgcaccgagactga

SEQ ID NO: 87 - DNA, 3750 bp, Artificial
  Gm205-1 FAD3A Allele #1 (SEQ ID NO:87)
atggttaaagacacaaagcctttagcctatgctgctaataatggataccaaaaggaagcttttgatcccagtgctcctccaccgtttaagattgcagaaatcagagttgcaataccaaaacattgctgggtcaagaatccatggagatccctcagttatgttctcagggatgtgcttgtaattgctgcattgatggctgctgcaagtcacttcaacaactggcttctctggctaatctattggcccattcaaggaacaatgttctgggctctgtttgttcttggacatgattggtaattaattaatttgttgttacttttttgttataatatgaatctcacacactgctttgttatgcctacctcatttcatttggctttagacaacttttttggttatgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaaggaatctttatacttcagataaagctgttcttgaacatttttttttgtcattatcttagttaaccgagaagatttacaagaatctagacaacatgacaagacttgttagattcactgtgccatttccattgtttgtgtatccaatttatttggtgagtgcttttttttttttacttggaagactacaacacattattattattataatatggttcaaatcaatgacttttaatttctttgtgatgtgcactccattttcagttctcaagaagccccggaaaggaaggttctcacttcaatccctacagcaatctgttcccacccagtgagagaaagggaatagcaatatcaacactgtgttgggttaccatgttttctatgcttatctatctctccttcataactagtccagttctattgctcaagctctatggaattccatattgggtaattaaattactcttacattactttttcctctttttttttatgggtcttaactagtatcacaaaaatattggttaaaaaattttaaaaaaatatttattatgtaaatcataaaagaacataaaaaaaatgatgaataacataattttcgtctcttattaaaaatatttttattttaaatttcttaatcaatatatttagaatctggttaacattttttgaatatttcaattctccaattaaaaatttgaaatagtcaccattaattatgtaattgtttgaacacgtgcagatatttgttatgtggctggactttgtcacatacttgcatcaccatggtcatcatcagaaactgccttggtatcgcggcaaggtaacaaaaataaatagaaaatagtgagtgaacacttaaatgttagatactaccttcttcttcttttttttttttttttgaggttaatgctagataatagctagaaagagaaagaaagacaaatataggtaaaaataaataatataacctgggaagaagaaaacataaaaaaagaaataatagagtctacgtaatgtttggatttttgagtgaaatggtgttcacctaccattactcaaagattctgttgtctacgtagtgtttggactttggagtgaaatggtgttcacctaccattactcagattctgttgtgtcccttagttactgtcttatattcttagggtatattctttattttacatccttttcacatcttacttgaaaagatttttaattattcattgaaatattaacgtgacagttaaattaaaataataaaaaattcgttaaaacttcaaataaataagagtgaaaggatcatcatttttcttctttcttttattgcgttattaatcatgcttctcttcttttttttcttcgctttccacccatatcaaattcatgtgaagtatgagaaaatcacgattcaatggaaagctacaggaactttttttgttttgtttttataatcggaattaatttatactccattttttcacaataaatgttacttagtgccttaaagataatatttgaaaaattaaaaaaattattaatacactgtactactatataatatttgacatatatttaacatgattttctattgaaaatttgtatttattattttttaatcaaaacccataaggcattaatttacaagacccatttttcatttatagctttacctgtgatcatttatagctttaagggacttagatgttacaatcttaattacaagtaaatatttatgaaaaacatgtgtcttaccccttaaccttacctcaacaaagaaagtgtgataagtggcaacacacgtgttgcttttttggcccagcaataacacgtgtttttgtggtgtacaaaaatggacaggaatggagttatttaagaggtggtctcacaactgtggatcgtgactatggttggatcaataacattcaccatgacattggcacccatgttattcaccatcttttccctcaaattcctcattatcacctcgttgaagcggtatattttactattattactcacctaaaaagaatgcaattagtacatttgttttatctcttggaagttagtcattttcagttgcatgattgtaatgttctctctatttttaaaccatgttttcacacctacttcgtttaaaataagaatgtggatactattctaatttctattaacttcttttaaaaaataatgtaaaactagtattaaaaaagaggaaatagattacactctactaatactaatagtataaaaaaaattacattgttattttatcacaaataattatatataattaatttttacaatcattatcttaaaagtcatgtatgatatacagtttttacatgctttggtacttattgtaaagttagtgatttattcattatttatgttatataattggcataaatatcatgtaaccagctcactatactataatgggaacttggtggtgaaaggggtttacaaccctcttttctaggtgtaggtgctttgatacttctggtccctttttatatcaatataaattatattttgctgataaaaaaaacattattaatatataatcattaacttctttaaaaaccgtacctaaaactttatattattaaaaagaagattgagatcagcaaaagaaaaaaaaattaacagtcatttgaattcactgcagacacaagcagcaaaatcagttcttggagagtattaccgtgagccagaaagatctgcaccattaccatttcatctaataaagtatttaattcagagtatgagacaagaccacttcgtaagtgacactggagatgtggtttattatcagactgattctctgcaccttcactcgcaccgagactga

SEQ ID NO: 88 - DNA, 3750 bp, Artificial; identical to SEQ ID NO: 87
  Gm205-2 FAD3A Allele #1 (SEQ ID NO:88)

SEQ ID NO: 89 - DNA, 3865 bp, Artificial
  Gm206-1 FAD3A Allele #1 (SEQ ID NO:89)
atggttaaagacacaaagcctttagcctatgctgctaataatggataccaaaaggaagcttttgatcccagtgctcctccaccgtttaagattgcagaaatcagagttgcaataccaaaacattgctgggtcaagaatccatggagatccctcagttatgttctcagggatgtgcttgtaattgctgcattgatggctgctgcaagtcacttcaacaactggcttctctggctaatctattggcccattcaaggaacaatgttctgggctctgtttgttcttggacatgattggtaattaattaatttgttgttacttttttgttataatatgaatctcacacactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaaggaatctttatacttcagataaagctgttcttgaacatttttttttgtcattatcttagttaaccgagaagatttacaagaatctagacaacatgacaagacttgttagattcactgtgccatttccattgtttgtgtatccaatttatttggtgagtgcttttttttttttacttggaagactacaacacattattattattataatatggttcaaatcaatgacttttaatttctttgtgatgtgcactccattttcagttctcaagaagccccggaaaggaaggttctcacttcaatccctacagcaatctgttcccacccagtgagagaaagggaatagcaatatcaacactgtgttgggttaccatgttttctatgcttatctatctctccttcataactagtccagttctattgctcaagctctatggaattccatattgggtaattaaattactcttacattactttttcctctttttttttatgggtcttaactagtatcacaaaaatattggttaaaaaattttaaaaaaatatttattatgtaaatcataaaagaacataaaaaaaatgatgaataacataattttcgtctcttattaaaaatatttttattttaaatttcttaatcaatatatttagaatctggttaacattttttgaatatttcaattctccaattaaaaatttgaaatagtcaccattaattatgtaattgtttgaacacgtgcagatatttgttatgtggctggactttgtcacatacttgcatcaccatggtcatcatcagaaactgccttggtatcgcggcaaggtaacaaaaataaatagaaaatagtgagtgaacacttaaatgttagatactaccttcttcttcttttttttttttttttgaggttaatgctagataatagctagaaagagaaagaaagacaaatataggtaaaaataaataatataacctgggaagaagaaaacataaaaaaagaaataatagagtctacgtaatgtttggatttttgagtgaaatggtgttcacctaccattactcaaagattctgttgtctacgtagtgtttggactttggagtgaaatggtgttcacctaccattactcagattctgttgtgtcccttagttactgtcttatattcttagggtatattctttattttacatccttttcacatcttacttgaaaagatttttaattattcattgaaatattaacgtgacagttaaattaaaataataaaaaattcgttaaaacttcaaataaataagagtgaaaggatcatcatttttcttctttcttttattgcgttattaatcatgcttctcttcttttttttcttcgctttccacccatatcaaattcatgtgaagtatgagaaaatcacgattcaatggaaagctacaggaactttttttgttttgtttttataatcggaattaatttatactccattttttcacaataaatgttacttagtgccttaaagataatatttgaaaaattaaaaaaattattaatacactgtactactatataatatttgacatatatttaacatgattttctattgaaaatttgtatttattattttttaatcaaaacccataaggcattaatttacaagacccatttttcatttatagctttacctgtgatcatttatagctttaagggacttagatgttacaatcttaattacaagtaaatatttatgaaaaacatgtgtcttaccccttaaccttacctcaacaaagaaagtgtgataagtggcaacacacgtgttgcttttttggcccagcaataacacgtgtttttgtggtgtacaaaaatggacaggaatggagttatttaagaggtggtctcacaactgtggatcgtgactatggttggatcaataacattcaccatgacattggcacccatgttattcaccatcttttccctcaaattcctcattatcacctcgttgaagcggtatattttactattattactcacctaaaaagaatgcaattagtacatttgttttatctcttggaagttagtcattttcagttgcatgattgtaatgttctctctatttttaaaccatgttttcacacctacttcgtttaaaataagaatgtggatactattctaatttctattaacttcttttaaaaaataatgtaaaactagtattaaaaaagaggaaatagattacactctactaatactaatagtataaaaaaaattacattgttattttatcacaaataattatatataattaatttttacaatcattatcttaaaagtcatgtatgatatacagtttttacatgctttggtacttattgtaaagttagtgatttattcattatttatgttatataattggcataaatatcatgtaaccagctcactatactataatgggaacttggtggtgaaaggggtttacaaccctcttttctaggtgtaggtgctttgatacttctggtccctttttatatcaatataaattatattttgctgataaaaaaaacattattaatatataatcattaacttctttaaaaaccgtacctaaaactttatattattaaaaagaagattgagatcagcaaaagaaaaaaaaattaacagtcatttgaattcactgcagacacaagcagcaaaatcagttcttggagagtattaccgtgagccagaaagatctgcaccattaccatttcatctaataaagtatttaattcagagtatgagacaagaccacttcgtaagtgacactggagatgtggtttattatcagactgattctctgcaccttcactcgcaccgagactga

SEQ ID NO: 90 - DNA, 3866 bp, Artificial
  Gm206-1 FAD3A Allele #2 (SEQ ID NO:90)
atggttaaagacacaaagcctttagcctatgctgctaataatggataccaaaaggaagcttttgatcccagtgctcctccaccgtttaagattgcagaaatcagagttgcaataccaaaacattgctgggtcaagaatccatggagatccctcagttatgttctcagggatgtgcttgtaattgctgcattgatggctgctgcaagtcacttcaacaactggcttctctggctaatctattggcccattcaaggaacaatgttctgggctctgtttgttcttggacatgattggtaattaattaatttgttgttacttttttgttataatatgaatctcacacactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacactttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaaggaatctttatacttcagataaagctgttcttgaacatttttttttgtcattatcttagttaaccgagaagatttacaagaatctagacaacatgacaagacttgttagattcactgtgccatttccattgtttgtgtatccaatttatttggtgagtgcttttttttttttacttggaagactacaacacattattattattataatatggttcaaatcaatgacttttaatttctttgtgatgtgcactccattttcagttctcaagaagccccggaaaggaaggttctcacttcaatccctacagcaatctgttcccacccagtgagagaaagggaatagcaatatcaacactgtgttgggttaccatgttttctatgcttatctatctctccttcataactagtccagttctattgctcaagctctatggaattccatattgggtaattaaattactcttacattactttttcctctttttttttatgggtcttaactagtatcacaaaaatattggttaaaaaattttaaaaaaatatttattatgtaaatcataaaagaacataaaaaaaatgatgaataacataattttcgtctcttattaaaaatatttttattttaaatttcttaatcaatatatttagaatctggttaacattttttgaatatttcaattctccaattaaaaatttgaaatagtcaccattaattatgtaattgtttgaacacgtgcagatatttgttatgtggctggactttgtcacatacttgcatcaccatggtcatcatcagaaactgccttggtatcgcggcaaggtaacaaaaataaatagaaaatagtgagtgaacacttaaatgttagatactaccttcttcttcttttttttttttttttgaggttaatgctagataatagctagaaagagaaagaaagacaaatataggtaaaaataaataatataacctgggaagaagaaaacataaaaaaagaaataatagagtctacgtaatgtttggatttttgagtgaaatggtgttcacctaccattactcaaagattctgttgtctacgtagtgtttggactttggagtgaaatggtgttcacctaccattactcagattctgttgtgtcccttagttactgtcttatattcttagggtatattctttattttacatccttttcacatcttacttgaaaagatttttaattattcattgaaatattaacgtgacagttaaattaaaataataaaaaattcgttaaaacttcaaataaataagagtgaaaggatcatcatttttcttctttcttttattgcgttattaatcatgcttctcttcttttttttcttcgctttccacccatatcaaattcatgtgaagtatgagaaaatcacgattcaatggaaagctacaggaactttttttgttttgtttttataatcggaattaatttatactccattttttcacaataaatgttacttagtgccttaaagataatatttgaaaaattaaaaaaattattaatacactgtactactatataatatttgacatatatttaacatgattttctattgaaaatttgtatttattattttttaatcaaaacccataaggcattaatttacaagacccatttttcatttatagctttacctgtgatcatttatagctttaagggacttagatgttacaatcttaattacaagtaaatatttatgaaaaacatgtgtcttaccccttaaccttacctcaacaaagaaagtgtgataagtggcaacacacgtgttgcttttttggcccagcaataacacgtgtttttgtggtgtacaaaaatggacaggaatggagttatttaagaggtggtctcacaactgtggatcgtgactatggttggatcaataacattcaccatgacattggcacccatgttattcaccatcttttccctcaaattcctcattatcacctcgttgaagcggtatattttactattattactcacctaaaaagaatgcaattagtacatttgttttatctcttggaagttagtcattttcagttgcatgattgtaatgttctctctatttttaaaccatgttttcacacctacttcgtttaaaataagaatgtggatactattctaatttctattaacttcttttaaaaaataatgtaaaactagtattaaaaaagaggaaatagattacactctactaatactaatagtataaaaaaaattacattgttattttatcacaaataattatatataattaatttttacaatcattatcttaaaagtcatgtatgatatacagtttttacatgctttggtacttattgtaaagttagtgatttattcattatttatgttatataattggcataaatatcatgtaaccagctcactatactataatgggaacttggtggtgaaaggggtttacaaccctcttttctaggtgtaggtgctttgatacttctggtccctttttatatcaatataaattatattttgctgataaaaaaaacattattaatatataatcattaacttctttaaaaaccgtacctaaaactttatattattaaaaagaagattgagatcagcaaaagaaaaaaaaattaacagtcatttgaattcactgcagacacaagcagcaaaatcagttcttggagagtattaccgtgagccagaaagatctgcaccattaccatttcatctaataaagtatttaattcagagtatgagacaagaccacttcgtaagtgacactggagatgtggtttattatcagactgattctctgcaccttcactcgcaccgagactga

SEQ ID NO: 91 - DNA, 3891 bp, Artificial
  Gm183-1 FAD3B Allele #1 (SEQ ID NO:91)
atggttaaagacacaaagcctttagcctatgctgccaataatggataccaacaaaagggttcttcttttgattttgatcctagcgctcctccaccgtttaagattgcagaaatcagagcttcaataccaaaacattgctgggtcaagaatccatggagatccctcagttatgttctcagggatgtgcttgtaattgctgcattggtggctgcagcaattcacttcgacaactggcttctctggctaatctattgccccattcaaggcacaatgttctgggctctctttgttcttggacatgattggtaataatttttgtgtttcttactcttttttttttttttttgtttatgatatgaatctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacatgcattcctcaattcttgtgccataccatggatggttagttcatactggcttttttgtttgttcatttgtcattgaaaaaaaatcttttgttgattcaattatttttatagtgtgtttggaagcccgtttgagaaaataagaaatcgcatctggaatgtgaaagttataactatttagcttcatctgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaaagggaatctttatgcttcctgaggctgttcttgaacatggctcttttttatgtgtcattatcttagttaacagagaagatttacaagaatctagacagcatgacaagactcattagattcactgtgccatttccattgtttgtgtatccaatttatttggtgagtgattttttgacttggaagacaacaacacattattattataatatggttcaaaacaatgactttttctttatgatgtgaactccattttttagttttcaagaagccccggaaaggaaggctctcacttcaatccctacagcaatctgtttccacccagtgagagaaaaggaatagcaatatcaacactgtgttgggctaccatgttttctctgcttatctatctctcattcataactagtccacttctagtgctcaagctctatggaattccatattgggtaactaaattactcctacattgttactttttcctccttttttttattatttcaattctccaattggaaatttgaaatagttaccataattatgtaattgtttgatcatgtgcagatatttgttatgtggctggactttgtcacatacttgcatcaccatggtcaccaccagaaactgccttggtaccgcggcaaggtaacaaaaataaatagaaaatagtgggtgaacacttaaatgcgagatagtaatacctaaaaaaagaaaaaaatataggtataataaataatataactttcaaaataaaaagaaatcatagagtctagcgtagtgtttggagtgaaatgatgttcacctaccattactcaaagattttgttgtgtcccttagttcattcttattattttacatatcttacttgaaaagactttttaattattcattgagatcttaaagtgactgttaaattaaaataaaaaacaagtttgttaaaacttcaaataaataagagtgaagggagtgtcatttgtcttctttcttttattgcgttattaatcacgtttctcttctctttttttttttttcttctctgctttccacccattatcaagttcatgtgaagcagtggcggatctatgtaaatgagtggggggcaattgcacccacaagattttattttttatttgtacaggaataataaaataaaactttgcccccataaaaaataaatattttttcttaaaataatgcaaaataaatataagaaataaaaagagaataaattattattaattttattattttgtactttttatttagtttttttagcggttagatttttttttcatgacattatgtaatcttttaaaagcatgtaatatttttattttgtgaaaataaatataaatgatcatattagtctcagaatgtataaactaataataattttatcactaaaagaaattctaatttagtccataaataagtaaaacaagtgacaattatattttatatttacttaatgtgaaataatacttgaacattataataaaacttaatgacaggagatattacatagtgccataaagatattttaaaaaataaaatcattaatacactgtactactatataatattcgatatatatttttaacatgattctcaatagaaaaattgtattgattatattttattagacatgaatttacaagccccgtttttcatttatagctcttacctgtgatctattgttttgcttcgctgtttttgttggtcaagggacttagatgtcacaatattaatactagaagtaaatatttatgaaaacatgtaccttacctcaacaaagaaagtgtggtaagtggcaacacacgtgttgcatttttggcccagcaataacacgtgtttttgtggtgtactaaaatggacaggaatggagttatttaagaggtggcctcaccactgtggatcgtgactatggttggatcaataacattcaccatgacattggcacccatgttatccaccatcttttcccccaaattcctcattatcacctcgttgaagcggtacattttattgcttattcacctaaaaacaatacaattagtacatttgttttatctcttggaagttagtcattttcagttgcatgattctaatgctctctccattcttaaatcatgttttcacacccacttcatttaaaataagaacgtgggtgttattttaatttctattcactaacatgagaaattaacttatttcaagtaataattttaaaatatttttatgctattattttattacaaataattatgtatattaagtttattgattttataataattatattaaaattatatcgatattaatttttgattcactgatagtgttttatattgttagtactgtgcatttattttaaaattggcataaataatatatgtaaccagctcactatactatactgggagcttggtggtgaaaggggttcccaaccctcctttctaggtgtacatgctttgatacttctggtaccttcttatatcaatataaattatattttgctgataaaaaaacatggttaaccattaaattctttttttaaaaaaaaaactgtatctaaactttgtattattaaaaagaagtctgagattaacaataaactaacactcatttgaattcactgcagacacaagcagcaaaaccagttcttggagattactaccgtgagccagaaagatctgcgccattaccatttcatctaataaagtatttaattcagagtatgagacaagaccacttcgtaagtgacactggagatgttgtttattatcagactgattctctgctcctccactcgcaacgagactga

SEQ ID NO: 92 - DNA, 3784 bp, Artificial
  Gm183-2 FAD3B Allele #1 (SEQ ID NO:92)
atggttaaagacacaaagcctttagcctatgctgccaataatggataccaacaaaagggttcttcttttgattttgatcctagcgctcctccaccgtttaagattgcagaaatcagagcttcaataccaaaacattgctgggtcaagaatccatggagatccctcagttatgttctcagggatgtgcttgtaattgctgcattggtggctgcagcaattcacttcgacaactggcttctctggctaatctattgccccattcaaggcacaatgttctgggctctctttgttcttggacatgattggtaataatttttgtgtttcttactcttttttttttttttttgtttatgatatgaatctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaataagaaatcgcatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaaagggaatctttatgcttcctgaggctgttcttgaacatggctcttttttatgtgtcattatcttagttaacagagaagatttacaagaatctagacagcatgacaagactcattagattcactgtgccatttccattgtttgtgtatccaatttatttggtgagtgattttttgacttggaagacaacaacacattattattataatatggttcaaaacaatgactttttctttatgatgtgaactccattttttagttttcaagaagccccggaaaggaaggctctcacttcaatccctacagcaatctgtttccacccagtgagagaaaaggaatagcaatatcaacactgtgttgggctaccatgttttctctgcttatctatctctcattcataactagtccacttctagtgctcaagctctatggaattccatattgggtaactaaattactcctacattgttactttttcctccttttttttattatttcaattctccaattggaaatttgaaatagttaccataattatgtaattgtttgatcatgtgcagatatttgttatgtggctggactttgtcacatacttgcatcaccatggtcaccaccagaaactgccttggtaccgcggcaaggtaacaaaaataaatagaaaatagtgggtgaacacttaaatgcgagatagtaatacctaaaaaaagaaaaaaatataggtataataaataatataactttcaaaataaaaagaaatcatagagtctagcgtagtgtttggagtgaaatgatgttcacctaccattactcaaagattttgttgtgtcccttagttcattcttattattttacatatcttacttgaaaagactttttaattattcattgagatcttaaagtgactgttaaattaaaataaaaaacaagtttgttaaaacttcaaataaataagagtgaagggagtgtcatttgtcttctttcttttattgcgttattaatcacgtttctcttctctttttttttttttcttctctgctttccacccattatcaagttcatgtgaagcagtggcggatctatgtaaatgagtggggggcaattgcacccacaagattttattttttatttgtacaggaataataaaataaaactttgcccccataaaaaataaatattttttcttaaaataatgcaaaataaatataagaaataaaaagagaataaattattattaattttattattttgtactttttatttagtttttttagcggttagatttttttttcatgacattatgtaatcttttaaaagcatgtaatatttttattttgtgaaaataaatataaatgatcatattagtctcagaatgtataaactaataataattttatcactaaaagaaattctaatttagtccataaataagtaaaacaagtgacaattatattttatatttacttaatgtgaaataatacttgaacattataataaaacttaatgacaggagatattacatagtgccataaagatattttaaaaaataaaatcattaatacactgtactactatataatattcgatatatatttttaacatgattctcaatagaaaaattgtattgattatattttattagacatgaatttacaagccccgtttttcatttatagctcttacctgtgatctattgttttgcttcgctgtttttgttggtcaagggacttagatgtcacaatattaatactagaagtaaatatttatgaaaacatgtaccttacctcaacaaagaaagtgtggtaagtggcaacacacgtgttgcatttttggcccagcaataacacgtgtttttgtggtgtactaaaatggacaggaatggagttatttaagaggtggcctcaccactgtggatcgtgactatggttggatcaataacattcaccatgacattggcacccatgttatccaccatcttttcccccaaattcctcattatcacctcgttgaagcggtacattttattgcttattcacctaaaaacaatacaattagtacatttgttttatctcttggaagttagtcattttcagttgcatgattctaatgctctctccattcttaaatcatgttttcacacccacttcatttaaaataagaacgtgggtgttattttaatttctattcactaacatgagaaattaacttatttcaagtaataattttaaaatatttttatgctattattttattacaaataattatgtatattaagtttattgattttataataattatattaaaattatatcgatattaatttttgattcactgatagtgttttatattgttagtactgtgcatttattttaaaattggcataaataatatatgtaaccagctcactatactatactgggagcttggtggtgaaaggggttcccaaccctcctttctaggtgtacatgctttgatacttctggtaccttcttatatcaatataaattatattttgctgataaaaaaacatggttaaccattaaattctttttttaaaaaaaaaactgtatctaaactttgtattattaaaaagaagtctgagattaacaataaactaacactcatttgaattcactgcagacacaagcagcaaaaccagttcttggagattactaccgtgagccagaaagatctgcgccattaccatttcatctaataaagtatttaattcagagtatgagacaagaccacttcgtaagtgacactggagatgttgtttattatcagactgattctctgctcctccactcgcaacgagactga

SEQ ID NO: 93 - DNA, 3889 bp, Artificial
  Gm183-6 FAD3B Allele #1 (SEQ ID NO:93)
atggttaaagacacaaagcctttagcctatgctgccaataatggataccaacaaaagggttcttcttttgattttgatcctagcgctcctccaccgtttaagattgcagaaatcagagcttcaataccaaaacattgctgggtcaagaatccatggagatccctcagttatgttctcagggatgtgcttgtaattgctgcattggtggctgcagcaattcacttcgacaactggcttctctggctaatctattgccccattcaaggcacaatgttctgggctctctttgttcttggacatgattggtaataatttttgtgtttcttactcttttttttttttttttgtttatgatatgaatctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacattcctcaattcttgtgccataccatggatggttagttcatactggcttttttgtttgttcatttgtcattgaaaaaaaatcttttgttgattcaattatttttatagtgtgtttggaagcccgtttgagaaaataagaaatcgcatctggaatgtgaaagttataactatttagcttcatctgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaaagggaatctttatgcttcctgaggctgttcttgaacatggctcttttttatgtgtcattatcttagttaacagagaagatttacaagaatctagacagcatgacaagactcattagattcactgtgccatttccattgtttgtgtatccaatttatttggtgagtgattttttgacttggaagacaacaacacattattattataatatggttcaaaacaatgactttttctttatgatgtgaactccattttttagttttcaagaagccccggaaaggaaggctctcacttcaatccctacagcaatctgtttccacccagtgagagaaaaggaatagcaatatcaacactgtgttgggctaccatgttttctctgcttatctatctctcattcataactagtccacttctagtgctcaagctctatggaattccatattgggtaactaaattactcctacattgttactttttcctccttttttttattatttcaattctccaattggaaatttgaaatagttaccataattatgtaattgtttgatcatgtgcagatatttgttatgtggctggactttgtcacatacttgcatcaccatggtcaccaccagaaactgccttggtaccgcggcaaggtaacaaaaataaatagaaaatagtgggtgaacacttaaatgcgagatagtaatacctaaaaaaagaaaaaaatataggtataataaataatataactttcaaaataaaaagaaatcatagagtctagcgtagtgtttggagtgaaatgatgttcacctaccattactcaaagattttgttgtgtcccttagttcattcttattattttacatatcttacttgaaaagactttttaattattcattgagatcttaaagtgactgttaaattaaaataaaaaacaagtttgttaaaacttcaaataaataagagtgaagggagtgtcatttgtcttctttcttttattgcgttattaatcacgtttctcttctctttttttttttttcttctctgctttccacccattatcaagttcatgtgaagcagtggcggatctatgtaaatgagtggggggcaattgcacccacaagattttattttttatttgtacaggaataataaaataaaactttgcccccataaaaaataaatattttttcttaaaataatgcaaaataaatataagaaataaaaagagaataaattattattaattttattattttgtactttttatttagtttttttagcggttagatttttttttcatgacattatgtaatcttttaaaagcatgtaatatttttattttgtgaaaataaatataaatgatcatattagtctcagaatgtataaactaataataattttatcactaaaagaaattctaatttagtccataaataagtaaaacaagtgacaattatattttatatttacttaatgtgaaataatacttgaacattataataaaacttaatgacaggagatattacatagtgccataaagatattttaaaaaataaaatcattaatacactgtactactatataatattcgatatatatttttaacatgattctcaatagaaaaattgtattgattatattttattagacatgaatttacaagccccgtttttcatttatagctcttacctgtgatctattgttttgcttcgctgtttttgttggtcaagggacttagatgtcacaatattaatactagaagtaaatatttatgaaaacatgtaccttacctcaacaaagaaagtgtggtaagtggcaacacacgtgttgcatttttggcccagcaataacacgtgtttttgtggtgtactaaaatggacaggaatggagttatttaagaggtggcctcaccactgtggatcgtgactatggttggatcaataacattcaccatgacattggcacccatgttatccaccatcttttcccccaaattcctcattatcacctcgttgaagcggtacattttattgcttattcacctaaaaacaatacaattagtacatttgttttatctcttggaagttagtcattttcagttgcatgattctaatgctctctccattcttaaatcatgttttcacacccacttcatttaaaataagaacgtgggtgttattttaatttctattcactaacatgagaaattaacttatttcaagtaataattttaaaatatttttatgctattattttattacaaataattatgtatattaagtttattgattttataataattatattaaaattatatcgatattaatttttgattcactgatagtgttttatattgttagtactgtgcatttattttaaaattggcataaataatatatgtaaccagctcactatactatactgggagcttggtggtgaaaggggttcccaaccctcctttctaggtgtacatgctttgatacttctggtaccttcttatatcaatataaattatattttgctgataaaaaaacatggttaaccattaaattctttttttaaaaaaaaaactgtatctaaactttgtattattaaaaagaagtctgagattaacaataaactaacactcatttgaattcactgcagacacaagcagcaaaaccagttcttggagattactaccgtgagccagaaagatctgcgccattaccatttcatctaataaagtatttaattcagagtatgagacaagaccacttcgtaagtgacactggagatgttgtttattatcagactgattctctgctcctccactcgcaacgagactga

SEQ ID NO: 94 - DNA, 3893 bp, Artificial
  Gm183-6 FAD3B Allele #2 (SEQ ID NO:94)
atggttaaagacacaaagcctttagcctatgctgccaataatggataccaacaaaagggttcttcttttgattttgatcctagcgctcctccaccgtttaagattgcagaaatcagagcttcaataccaaaacattgctgggtcaagaatccatggagatccctcagttatgttctcagggatgtgcttgtaattgctgcattggtggctgcagcaattcacttcgacaactggcttctctggctaatctattgccccattcaaggcacaatgttctgggctctctttgttcttggacatgattggtaataatttttgtgtttcttactcttttttttttttttttgtttatgatatgaatctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatgcattcctcaattcttgtgccataccatggatggttagttcatactggcttttttgtttgttcatttgtcattgaaaaaaaatcttttgttgattcaattatttttatagtgtgtttggaagcccgtttgagaaaataagaaatcgcatctggaatgtgaaagttataactatttagcttcatctgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaaagggaatctttatgcttcctgaggctgttcttgaacatggctcttttttatgtgtcattatcttagttaacagagaagatttacaagaatctagacagcatgacaagactcattagattcactgtgccatttccattgtttgtgtatccaatttatttggtgagtgattttttgacttggaagacaacaacacattattattataatatggttcaaaacaatgactttttctttatgatgtgaactccattttttagttttcaagaagccccggaaaggaaggctctcacttcaatccctacagcaatctgtttccacccagtgagagaaaaggaatagcaatatcaacactgtgttgggctaccatgttttctctgcttatctatctctcattcataactagtccacttctagtgctcaagctctatggaattccatattgggtaactaaattactcctacattgttactttttcctccttttttttattatttcaattctccaattggaaatttgaaatagttaccataattatgtaattgtttgatcatgtgcagatatttgttatgtggctggactttgtcacatacttgcatcaccatggtcaccaccagaaactgccttggtaccgcggcaaggtaacaaaaataaatagaaaatagtgggtgaacacttaaatgcgagatagtaatacctaaaaaaagaaaaaaatataggtataataaataatataactttcaaaataaaaagaaatcatagagtctagcgtagtgtttggagtgaaatgatgttcacctaccattactcaaagattttgttgtgtcccttagttcattcttattattttacatatcttacttgaaaagactttttaattattcattgagatcttaaagtgactgttaaattaaaataaaaaacaagtttgttaaaacttcaaataaataagagtgaagggagtgtcatttgtcttctttcttttattgcgttattaatcacgtttctcttctctttttttttttttcttctctgctttccacccattatcaagttcatgtgaagcagtggcggatctatgtaaatgagtggggggcaattgcacccacaagattttattttttatttgtacaggaataataaaataaaactttgcccccataaaaaataaatattttttcttaaaataatgcaaaataaatataagaaataaaaagagaataaattattattaattttattattttgtactttttatttagtttttttagcggttagatttttttttcatgacattatgtaatcttttaaaagcatgtaatatttttattttgtgaaaataaatataaatgatcatattagtctcagaatgtataaactaataataattttatcactaaaagaaattctaatttagtccataaataagtaaaacaagtgacaattatattttatatttacttaatgtgaaataatacttgaacattataataaaacttaatgacaggagatattacatagtgccataaagatattttaaaaaataaaatcattaatacactgtactactatataatattcgatatatatttttaacatgattctcaatagaaaaattgtattgattatattttattagacatgaatttacaagccccgtttttcatttatagctcttacctgtgatctattgttttgcttcgctgtttttgttggtcaagggacttagatgtcacaatattaatactagaagtaaatatttatgaaaacatgtaccttacctcaacaaagaaagtgtggtaagtggcaacacacgtgttgcatttttggcccagcaataacacgtgtttttgtggtgtactaaaatggacaggaatggagttatttaagaggtggcctcaccactgtggatcgtgactatggttggatcaataacattcaccatgacattggcacccatgttatccaccatcttttcccccaaattcctcattatcacctcgttgaagcggtacattttattgcttattcacctaaaaacaatacaattagtacatttgttttatctcttggaagttagtcattttcagttgcatgattctaatgctctctccattcttaaatcatgttttcacacccacttcatttaaaataagaacgtgggtgttattttaatttctattcactaacatgagaaattaacttatttcaagtaataattttaaaatatttttatgctattattttattacaaataattatgtatattaagtttattgattttataataattatattaaaattatatcgatattaatttttgattcactgatagtgttttatattgttagtactgtgcatttattttaaaattggcataaataatatatgtaaccagctcactatactatactgggagcttggtggtgaaaggggttcccaaccctcctttctaggtgtacatgctttgatacttctggtaccttcttatatcaatataaattatattttgctgataaaaaaacatggttaaccattaaattctttttttaaaaaaaaaactgtatctaaactttgtattattaaaaagaagtctgagattaacaataaactaacactcatttgaattcactgcagacacaagcagcaaaaccagttcttggagattactaccgtgagccagaaagatctgcgccattaccatttcatctaataaagtatttaattcagagtatgagacaagaccacttcgtaagtgacactggagatgttgtttattatcagactgattctctgctcctccactcgcaacgagactga

SEQ ID NO: 95 - DNA, 3890 bp, Artificial
  Gm183-8 FAD3B Allele #1 (SEQ ID NO:95)
atggttaaagacacaaagcctttagcctatgctgccaataatggataccaacaaaagggttcttcttttgattttgatcctagcgctcctccaccgtttaagattgcagaaatcagagcttcaataccaaaacattgctgggtcaagaatccatggagatccctcagttatgttctcagggatgtgcttgtaattgctgcattggtggctgcagcaattcacttcgacaactggcttctctggctaatctattgccccattcaaggcacaatgttctgggctctctttgttcttggacatgattggtaataatttttgtgtttcttactcttttttttttttttttgtttatgatatgaatctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacagcattcctcaattcttgtgccataccatggatggttagttcatactggcttttttgtttgttcatttgtcattgaaaaaaaatcttttgttgattcaattatttttatagtgtgtttggaagcccgtttgagaaaataagaaatcgcatctggaatgtgaaagttataactatttagcttcatctgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaaagggaatctttatgcttcctgaggctgttcttgaacatggctcttttttatgtgtcattatcttagttaacagagaagatttacaagaatctagacagcatgacaagactcattagattcactgtgccatttccattgtttgtgtatccaatttatttggtgagtgattttttgacttggaagacaacaacacattattattataatatggttcaaaacaatgactttttctttatgatgtgaactccattttttagttttcaagaagccccggaaaggaaggctctcacttcaatccctacagcaatctgtttccacccagtgagagaaaaggaatagcaatatcaacactgtgttgggctaccatgttttctctgcttatctatctctcattcataactagtccacttctagtgctcaagctctatggaattccatattgggtaactaaattactcctacattgttactttttcctccttttttttattatttcaattctccaattggaaatttgaaatagttaccataattatgtaattgtttgatcatgtgcagatatttgttatgtggctggactttgtcacatacttgcatcaccatggtcaccaccagaaactgccttggtaccgcggcaaggtaacaaaaataaatagaaaatagtgggtgaacacttaaatgcgagatagtaatacctaaaaaaagaaaaaaatataggtataataaataatataactttcaaaataaaaagaaatcatagagtctagcgtagtgtttggagtgaaatgatgttcacctaccattactcaaagattttgttgtgtcccttagttcattcttattattttacatatcttacttgaaaagactttttaattattcattgagatcttaaagtgactgttaaattaaaataaaaaacaagtttgttaaaacttcaaataaataagagtgaagggagtgtcatttgtcttctttcttttattgcgttattaatcacgtttctcttctctttttttttttttcttctctgctttccacccattatcaagttcatgtgaagcagtggcggatctatgtaaatgagtggggggcaattgcacccacaagattttattttttatttgtacaggaataataaaataaaactttgcccccataaaaaataaatattttttcttaaaataatgcaaaataaatataagaaataaaaagagaataaattattattaattttattattttgtactttttatttagtttttttagcggttagatttttttttcatgacattatgtaatcttttaaaagcatgtaatatttttattttgtgaaaataaatataaatgatcatattagtctcagaatgtataaactaataataattttatcactaaaagaaattctaatttagtccataaataagtaaaacaagtgacaattatattttatatttacttaatgtgaaataatacttgaacattataataaaacttaatgacaggagatattacatagtgccataaagatattttaaaaaataaaatcattaatacactgtactactatataatattcgatatatatttttaacatgattctcaatagaaaaattgtattgattatattttattagacatgaatttacaagccccgtttttcatttatagctcttacctgtgatctattgttttgcttcgctgtttttgttggtcaagggacttagatgtcacaatattaatactagaagtaaatatttatgaaaacatgtaccttacctcaacaaagaaagtgtggtaagtggcaacacacgtgttgcatttttggcccagcaataacacgtgtttttgtggtgtactaaaatggacaggaatggagttatttaagaggtggcctcaccactgtggatcgtgactatggttggatcaataacattcaccatgacattggcacccatgttatccaccatcttttcccccaaattcctcattatcacctcgttgaagcggtacattttattgcttattcacctaaaaacaatacaattagtacatttgttttatctcttggaagttagtcattttcagttgcatgattctaatgctctctccattcttaaatcatgttttcacacccacttcatttaaaataagaacgtgggtgttattttaatttctattcactaacatgagaaattaacttatttcaagtaataattttaaaatatttttatgctattattttattacaaataattatgtatattaagtttattgattttataataattatattaaaattatatcgatattaatttttgattcactgatagtgttttatattgttagtactgtgcatttattttaaaattggcataaataatatatgtaaccagctcactatactatactgggagcttggtggtgaaaggggttcccaaccctcctttctaggtgtacatgctttgatacttctggtaccttcttatatcaatataaattatattttgctgataaaaaaacatggttaaccattaaattctttttttaaaaaaaaaactgtatctaaactttgtattattaaaaagaagtctgagattaacaataaactaacactcatttgaattcactgcagacacaagcagcaaaaccagttcttggagattactaccgtgagccagaaagatctgcgccattaccatttcatctaataaagtatttaattcagagtatgagacaagaccacttcgtaagtgacactggagatgttgtttattatcagactgattctctgctcctccactcgcaacgagactga

SEQ ID NO: 96 - DNA, 3887 bp, Artificial
  Gm183-8 FAD3B Allele #2 (SEQ ID NO:96)
atggttaaagacacaaagcctttagcctatgctgccaataatggataccaacaaaagggttcttcttttgattttgatcctagcgctcctccaccgtttaagattgcagaaatcagagcttcaataccaaaacattgctgggtcaagaatccatggagatccctcagttatgttctcagggatgtgcttgtaattgctgcattggtggctgcagcaattcacttcgacaactggcttctctggctaatctattgccccattcaaggcacaatgttctgggctctctttgttcttggacatgattggtaataatttttgtgtttcttactcttttttttttttttttgtttatgatatgaatctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatggcctggtgggacattcctcaattcttgtgccataccatggatggttagttcatactggcttttttgtttgttcatttgtcattgaaaaaaaatcttttgttgattcaattatttttatagtgtgtttggaagcccgtttgagaaaataagaaatcgcatctggaatgtgaaagttataactatttagcttcatctgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaaagggaatctttatgcttcctgaggctgttcttgaacatggctcttttttatgtgtcattatcttagttaacagagaagatttacaagaatctagacagcatgacaagactcattagattcactgtgccatttccattgtttgtgtatccaatttatttggtgagtgattttttgacttggaagacaacaacacattattattataatatggttcaaaacaatgactttttctttatgatgtgaactccattttttagttttcaagaagccccggaaaggaaggctctcacttcaatccctacagcaatctgtttccacccagtgagagaaaaggaatagcaatatcaacactgtgttgggctaccatgttttctctgcttatctatctctcattcataactagtccacttctagtgctcaagctctatggaattccatattgggtaactaaattactcctacattgttactttttcctccttttttttattatttcaattctccaattggaaatttgaaatagttaccataattatgtaattgtttgatcatgtgcagatatttgttatgtggctggactttgtcacatacttgcatcaccatggtcaccaccagaaactgccttggtaccgcggcaaggtaacaaaaataaatagaaaatagtgggtgaacacttaaatgcgagatagtaatacctaaaaaaagaaaaaaatataggtataataaataatataactttcaaaataaaaagaaatcatagagtctagcgtagtgtttggagtgaaatgatgttcacctaccattactcaaagattttgttgtgtcccttagttcattcttattattttacatatcttacttgaaaagactttttaattattcattgagatcttaaagtgactgttaaattaaaataaaaaacaagtttgttaaaacttcaaataaataagagtgaagggagtgtcatttgtcttctttcttttattgcgttattaatcacgtttctcttctctttttttttttttcttctctgctttccacccattatcaagttcatgtgaagcagtggcggatctatgtaaatgagtggggggcaattgcacccacaagattttattttttatttgtacaggaataataaaataaaactttgcccccataaaaaataaatattttttcttaaaataatgcaaaataaatataagaaataaaaagagaataaattattattaattttattattttgtactttttatttagtttttttagcggttagatttttttttcatgacattatgtaatcttttaaaagcatgtaatatttttattttgtgaaaataaatataaatgatcatattagtctcagaatgtataaactaataataattttatcactaaaagaaattctaatttagtccataaataagtaaaacaagtgacaattatattttatatttacttaatgtgaaataatacttgaacattataataaaacttaatgacaggagatattacatagtgccataaagatattttaaaaaataaaatcattaatacactgtactactatataatattcgatatatatttttaacatgattctcaatagaaaaattgtattgattatattttattagacatgaatttacaagccccgtttttcatttatagctcttacctgtgatctattgttttgcttcgctgtttttgttggtcaagggacttagatgtcacaatattaatactagaagtaaatatttatgaaaacatgtaccttacctcaacaaagaaagtgtggtaagtggcaacacacgtgttgcatttttggcccagcaataacacgtgtttttgtggtgtactaaaatggacaggaatggagttatttaagaggtggcctcaccactgtggatcgtgactatggttggatcaataacattcaccatgacattggcacccatgttatccaccatcttttcccccaaattcctcattatcacctcgttgaagcggtacattttattgcttattcacctaaaaacaatacaattagtacatttgttttatctcttggaagttagtcattttcagttgcatgattctaatgctctctccattcttaaatcatgttttcacacccacttcatttaaaataagaacgtgggtgttattttaatttctattcactaacatgagaaattaacttatttcaagtaataattttaaaatatttttatgctattattttattacaaataattatgtatattaagtttattgattttataataattatattaaaattatatcgatattaatttttgattcactgatagtgttttatattgttagtactgtgcatttattttaaaattggcataaataatatatgtaaccagctcactatactatactgggagcttggtggtgaaaggggttcccaaccctcctttctaggtgtacatgctttgatacttctggtaccttcttatatcaatataaattatattttgctgataaaaaaacatggttaaccattaaattctttttttaaaaaaaaaactgtatctaaactttgtattattaaaaagaagtctgagattaacaataaactaacactcatttgaattcactgcagacacaagcagcaaaaccagttcttggagattactaccgtgagccagaaagatctgcgccattaccatttcatctaataaagtatttaattcagagtatgagacaagaccacttcgtaagtgacactggagatgttgtttattatcagactgattctctgctcctccactcgcaacgagactga

SEQ ID NO: 97 - DNA, 3890 bp, Artificial; identical to SEQ ID NO: 95
  Gm205-1 FAD3B Allele #1 (SEQ ID NO:97)

SEQ ID NO: 98 - DNA, 3891 bp, Artificial
  Gm205-1 FAD3B Allele #2 (SEQ ID NO:98)
atggttaaagacacaaagcctttagcctatgctgccaataatggataccaacaaaagggttcttcttttgattttgatcctagcgctcctccaccgtttaagattgcagaaatcagagcttcaataccaaaacattgctgggtcaagaatccatggagatccctcagttatgttctcagggatgtgcttgtaattgctgcattggtggctgcagcaattcacttcgacaactggcttctctggctaatctattgccccattcaaggcacaatgttctgggctctctttgttcttggacatgattggtaataatttttgtgtttcttactcttttttttttttttttgtttatgatatgaatctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacgcattcctcaattcttgtgccataccatggatggttagttcatactggcttttttgtttgttcatttgtcattgaaaaaaaatcttttgttgattcaattatttttatagtgtgtttggaagcccgtttgagaaaataagaaatcgcatctggaatgtgaaagttataactatttagcttcatctgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaaagggaatctttatgcttcctgaggctgttcttgaacatggctcttttttatgtgtcattatcttagttaacagagaagatttacaagaatctagacagcatgacaagactcattagattcactgtgccatttccattgtttgtgtatccaatttatttggtgagtgattttttgacttggaagacaacaacacattattattataatatggttcaaaacaatgactttttctttatgatgtgaactccattttttagttttcaagaagccccggaaaggaaggctctcacttcaatccctacagcaatctgtttccacccagtgagagaaaaggaatagcaatatcaacactgtgttgggctaccatgttttctctgcttatctatctctcattcataactagtccacttctagtgctcaagctctatggaattccatattgggtaactaaattactcctacattgttactttttcctccttttttttattatttcaattctccaattggaaatttgaaatagttaccataattatgtaattgtttgatcatgtgcagatatttgttatgtggctggactttgtcacatacttgcatcaccatggtcaccaccagaaactgccttggtaccgcggcaaggtaacaaaaataaatagaaaatagtgggtgaacacttaaatgcgagatagtaatacctaaaaaaagaaaaaaatataggtataataaataatataactttcaaaataaaaagaaatcatagagtctagcgtagtgtttggagtgaaatgatgttcacctaccattactcaaagattttgttgtgtcccttagttcattcttattattttacatatcttacttgaaaagactttttaattattcattgagatcttaaagtgactgttaaattaaaataaaaaacaagtttgttaaaacttcaaataaataagagtgaagggagtgtcatttgtcttctttcttttattgcgttattaatcacgtttctcttctctttttttttttttcttctctgctttccacccattatcaagttcatgtgaagcagtggcggatctatgtaaatgagtggggggcaattgcacccacaagattttattttttatttgtacaggaataataaaataaaactttgcccccataaaaaataaatattttttcttaaaataatgcaaaataaatataagaaataaaaagagaataaattattattaattttattattttgtactttttatttagtttttttagcggttagatttttttttcatgacattatgtaatcttttaaaagcatgtaatatttttattttgtgaaaataaatataaatgatcatattagtctcagaatgtataaactaataataattttatcactaaaagaaattctaatttagtccataaataagtaaaacaagtgacaattatattttatatttacttaatgtgaaataatacttgaacattataataaaacttaatgacaggagatattacatagtgccataaagatattttaaaaaataaaatcattaatacactgtactactatataatattcgatatatatttttaacatgattctcaatagaaaaattgtattgattatattttattagacatgaatttacaagccccgtttttcatttatagctcttacctgtgatctattgttttgcttcgctgtttttgttggtcaagggacttagatgtcacaatattaatactagaagtaaatatttatgaaaacatgtaccttacctcaacaaagaaagtgtggtaagtggcaacacacgtgttgcatttttggcccagcaataacacgtgtttttgtggtgtactaaaatggacaggaatggagttatttaagaggtggcctcaccactgtggatcgtgactatggttggatcaataacattcaccatgacattggcacccatgttatccaccatcttttcccccaaattcctcattatcacctcgttgaagcggtacattttattgcttattcacctaaaaacaatacaattagtacatttgttttatctcttggaagttagtcattttcagttgcatgattctaatgctctctccattcttaaatcatgttttcacacccacttcatttaaaataagaacgtgggtgttattttaatttctattcactaacatgagaaattaacttatttcaagtaataattttaaaatatttttatgctattattttattacaaataattatgtatattaagtttattgattttataataattatattaaaattatatcgatattaatttttgattcactgatagtgttttatattgttagtactgtgcatttattttaaaattggcataaataatatatgtaaccagctcactatactatactgggagcttggtggtgaaaggggttcccaaccctcctttctaggtgtacatgctttgatacttctggtaccttcttatatcaatataaattatattttgctgataaaaaaacatggttaaccattaaattctttttttaaaaaaaaaactgtatctaaactttgtattattaaaaagaagtctgagattaacaataaactaacactcatttgaattcactgcagacacaagcagcaaaaccagttcttggagattactaccgtgagccagaaagatctgcgccattaccatttcatctaataaagtatttaattcagagtatgagacaagaccacttcgtaagtgacactggagatgttgtttattatcagactgattctctgctcctccactcgcaacgagactga

SEQ ID NO: 99 - DNA, 3884 bp, Artificial
  Gm205-2 FAD3B Allele #1 (SEQ ID NO:99)
atggttaaagacacaaagcctttagcctatgctgccaataatggataccaacaaaagggttcttcttttgattttgatcctagcgctcctccaccgtttaagattgcagaaatcagagcttcaataccaaaacattgctgggtcaagaatccatggagatccctcagttatgttctcagggatgtgcttgtaattgctgcattggtggctgcagcaattcacttcgacaactggcttctctggctaatctattgccccattcaaggcacaatgttctgggctctctttgttcttggacatgattggtaataatttttgtgtttcttactcttttttttttttttttgtttatgatatgaatctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggttcctcaattcttgtgccataccatggatggttagttcatactggcttttttgtttgttcatttgtcattgaaaaaaaatcttttgttgattcaattatttttatagtgtgtttggaagcccgtttgagaaaataagaaatcgcatctggaatgtgaaagttataactatttagcttcatctgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaaagggaatctttatgcttcctgaggctgttcttgaacatggctcttttttatgtgtcattatcttagttaacagagaagatttacaagaatctagacagcatgacaagactcattagattcactgtgccatttccattgtttgtgtatccaatttatttggtgagtgattttttgacttggaagacaacaacacattattattataatatggttcaaaacaatgactttttctttatgatgtgaactccattttttagttttcaagaagccccggaaaggaaggctctcacttcaatccctacagcaatctgtttccacccagtgagagaaaaggaatagcaatatcaacactgtgttgggctaccatgttttctctgcttatctatctctcattcataactagtccacttctagtgctcaagctctatggaattccatattgggtaactaaattactcctacattgttactttttcctccttttttttattatttcaattctccaattggaaatttgaaatagttaccataattatgtaattgtttgatcatgtgcagatatttgttatgtggctggactttgtcacatacttgcatcaccatggtcaccaccagaaactgccttggtaccgcggcaaggtaacaaaaataaatagaaaatagtgggtgaacacttaaatgcgagatagtaatacctaaaaaaagaaaaaaatataggtataataaataatataactttcaaaataaaaagaaatcatagagtctagcgtagtgtttggagtgaaatgatgttcacctaccattactcaaagattttgttgtgtcccttagttcattcttattattttacatatcttacttgaaaagactttttaattattcattgagatcttaaagtgactgttaaattaaaataaaaaacaagtttgttaaaacttcaaataaataagagtgaagggagtgtcatttgtcttctttcttttattgcgttattaatcacgtttctcttctctttttttttttttcttctctgctttccacccattatcaagttcatgtgaagcagtggcggatctatgtaaatgagtggggggcaattgcacccacaagattttattttttatttgtacaggaataataaaataaaactttgcccccataaaaaataaatattttttcttaaaataatgcaaaataaatataagaaataaaaagagaataaattattattaattttattattttgtactttttatttagtttttttagcggttagatttttttttcatgacattatgtaatcttttaaaagcatgtaatatttttattttgtgaaaataaatataaatgatcatattagtctcagaatgtataaactaataataattttatcactaaaagaaattctaatttagtccataaataagtaaaacaagtgacaattatattttatatttacttaatgtgaaataatacttgaacattataataaaacttaatgacaggagatattacatagtgccataaagatattttaaaaaataaaatcattaatacactgtactactatataatattcgatatatatttttaacatgattctcaatagaaaaattgtattgattatattttattagacatgaatttacaagccccgtttttcatttatagctcttacctgtgatctattgttttgcttcgctgtttttgttggtcaagggacttagatgtcacaatattaatactagaagtaaatatttatgaaaacatgtaccttacctcaacaaagaaagtgtggtaagtggcaacacacgtgttgcatttttggcccagcaataacacgtgtttttgtggtgtactaaaatggacaggaatggagttatttaagaggtggcctcaccactgtggatcgtgactatggttggatcaataacattcaccatgacattggcacccatgttatccaccatcttttcccccaaattcctcattatcacctcgttgaagcggtacattttattgcttattcacctaaaaacaatacaattagtacatttgttttatctcttggaagttagtcattttcagttgcatgattctaatgctctctccattcttaaatcatgttttcacacccacttcatttaaaataagaacgtgggtgttattttaatttctattcactaacatgagaaattaacttatttcaagtaataattttaaaatatttttatgctattattttattacaaataattatgtatattaagtttattgattttataataattatattaaaattatatcgatattaatttttgattcactgatagtgttttatattgttagtactgtgcatttattttaaaattggcataaataatatatgtaaccagctcactatactatactgggagcttggtggtgaaaggggttcccaaccctcctttctaggtgtacatgctttgatacttctggtaccttcttatatcaatataaattatattttgctgataaaaaaacatggttaaccattaaattctttttttaaaaaaaaaactgtatctaaactttgtattattaaaaagaagtctgagattaacaataaactaacactcatttgaattcactgcagacacaagcagcaaaaccagttcttggagattactaccgtgagccagaaagatctgcgccattaccatttcatctaataaagtatttaattcagagtatgagacaagaccacttcgtaagtgacactggagatgttgtttattatcagactgattctctgctcctccactcgcaacgagactga

SEQ ID NO: 100 - DNA, 1268 bp, Artificial
  Gm026-18 FAD2-1A KO Allele (SEQ ID NO:100)
atggtcatgatttcactctctctaatctctccattcattttgtagttgtcattatctttagatttttcactacctggtttaaaattgagggattgtagttctgttggtacatattacacattcagcaaaacaactgaaactcaactgaacttgtttatactttgacacagggtctagcaaaggaaacaacaatgggaggtagaggtcgtgtggccaaagtggaagttcaagggaagaagcctctctcaagggttccaaacacaaagccaccattcactgttggccaactcaagaaagcaattccaccacactgctttcagcgctccctcctcacttcattctcctatgttgtttatgacctttcatttgccttcattttctacattgccaccacctacttccacctccttcctcaacccttttccctcattgcatggccaatctattgggttctccaaggttgccttctcactggtgtgtgggtgattgctcacgagtgtggtcaccatgccttcagcaagtaccaatgggttgatgatgttgtgggtttgacccttcactcaacacttgaccgtgatgaagtgtttgtcccaaaaccaaaatccaaagttgcatggttttccaagtacttaaacaaccctctaggaagggctgtttctcttctcgtcacactcacaatagggtggcctatgtatttagccttcaatgtctctggtagaccctatgatagttttgcaagccactaccacccttatgctcccatatattctaaccgtgagaggcttctgatctatgtctctgatgttgctttgttttctgtgacttactctctctaccgtgttgcaaccctgaaagggttggtttggctgctatgtgtttatggggtgcctttgctcattgtgaacggttttcttgtgactatcacatatttgcagcacacacactttgccttgcctcattacgattcatcagaatgggactggctgaagggagctttggcaactatggacagagattatgggattctgaacaaggtgtttcatcacataactgatactcatgtggctcaccatctcttctctacaatgccacattaccatgcaatggaggcaaccaatgcaatcaagccaatattgggtgagtactaccaatttgatgacacaccattttacaaggcactgtggagagaagcgagagagtgcctctatgtggagccagatgaaggaacatccgagaagggcgtgtattggtacaggaacaagtattga

SEQ ID NO: 101 - DNA, 1301 bp, Artificial
  Gm026-18 FAD2-1B KO Allele (SEQ ID NO:101)
atggtcatgatttcactctctctaatctgtcacttccctccattcattttgtacttctcatatttttcacttcctggttgaaaattgtagttctcttggtacatactagtattagacattcagcaacaacaactgaactgaacttctttatactttgacacagggtctagcaaaggaaacaataatgggaggtggaggccgtgtggccaaagttgaaattcagcagaagaagcctctctcaagggttccaaacacaaagccaccattcactgttggccaactcaagaaagccattccaccgcactgctttcagcgttccctcctcacttcattgtcctatgttgtttatgacctttcattggctttcattttctacattgccaccacctacttccacctcctccctcaccccttttccctcattgcatggccaatctattgggttctccaaggttgcattcttactggcgtgtgggtgattgctcacgagtgtggtcaccatgccttcagcaagtacccatgggttgatgatgttatgggtttgaccgttcactcagcacttttagtcccttatttctcatggaaaataagccatcgcccttgaccgtgatgaagtgtttgtcccaaaaccaaaatccaaagttgcatggtacaccaagtacctgaacaaccctctaggaagggctgcttctcttctcatcacactcacaatagggtggcctttgtatttagccttcaatgtctctggcagaccctatgatggttttgctagccactaccacccttatgctcccatatattcaaatcgtgagaggcttttgatctatgtctctgatgttgctttgttttctgtgacttacttgctctaccgtgttgcaactatgaaagggttggtttggctgctatgtgtttatggggtgccattgctcattgtgaacggttttcttgtgaccatcacatatctgcagcacacacactatgccttgcctcactatgattcatcagaatgggattggctgaggggtgctttggcaactatggacagagattatggaattctgaacaaggtgtttcaccacataactgatactcatgtggctcaccatcttttctctacaatgccacattaccatgcaacggaggcaaccaatgcaatgaagccaatattgggtgagtactaccgatttgatgacacaccattttacaaggcactgtggagagaagcaagagagtgcctctatgtggagccagatgaaggaacatccgagaagggcgtgtattggtacaggaacaagtattga

SEQ ID NO: 102 - DNA, 3861 bp, Artificial; identical to SEQ ID NO: 68
  Gm183-4-(1,2,3,4) T1 FAD3A Allele #1 (SEQ ID NO: 102)

SEQ ID NO: 103 - DNA, 3864 bp, Artificial
  Gm183-5-8 T1 FAD3A Allele #1 (SEQ ID NO: 103)
atggttaaagacacaaagcctttagcctatgctgctaataatggataccaaaaggaagcttttgatcccagtgctcctccaccgtttaagattgcagaaatcagagttgcaataccaaaacattgctgggtcaagaatccatggagatccctcagttatgttctcagggatgtgcttgtaattgctgcattgatggctgctgcaagtcacttcaacaactggcttctctggctaatctattggcccattcaaggaacaatgttctgggctctgtttgttcttggacatgattggtaattaattaatttgttgttacttttttgttataatatgaatctcacacactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacactgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaaggaatctttatacttcagataaagctgttcttgaacatttttttttgtcattatcttagttaaccgagaagatttacaagaatctagacaacatgacaagacttgttagattcactgtgccatttccattgtttgtgtatccaatttatttggtgagtgcttttttttttttacttggaagactacaacacattattattattataatatggttcaaatcaatgacttttaatttctttgtgatgtgcactccattttcagttctcaagaagccccggaaaggaaggttctcacttcaatccctacagcaatctgttcccacccagtgagagaaagggaatagcaatatcaacactgtgttgggttaccatgttttctatgcttatctatctctccttcataactagtccagttctattgctcaagctctatggaattccatattgggtaattaaattactcttacattactttttcctctttttttttatgggtcttaactagtatcacaaaaatattggttaaaaaattttaaaaaaatatttattatgtaaatcataaaagaacataaaaaaaatgatgaataacataattttcgtctcttattaaaaatatttttattttaaatttcttaatcaatatatttagaatctggttaacattttttgaatatttcaattctccaattaaaaatttgaaatagtcaccattaattatgtaattgtttgaacacgtgcagatatttgttatgtggctggactttgtcacatacttgcatcaccatggtcatcatcagaaactgccttggtatcgcggcaaggtaacaaaaataaatagaaaatagtgagtgaacacttaaatgttagatactaccttcttcttcttttttttttttttttgaggttaatgctagataatagctagaaagagaaagaaagacaaatataggtaaaaataaataatataacctgggaagaagaaaacataaaaaaagaaataatagagtctacgtaatgtttggatttttgagtgaaatggtgttcacctaccattactcaaagattctgttgtctacgtagtgtttggactttggagtgaaatggtgttcacctaccattactcagattctgttgtgtcccttagttactgtcttatattcttagggtatattctttattttacatccttttcacatcttacttgaaaagatttttaattattcattgaaatattaacgtgacagttaaattaaaataataaaaaattcgttaaaacttcaaataaataagagtgaaaggatcatcatttttcttctttcttttattgcgttattaatcatgcttctcttcttttttttcttcgctttccacccatatcaaattcatgtgaagtatgagaaaatcacgattcaatggaaagctacaggaactttttttgttttgtttttataatcggaattaatttatactccattttttcacaataaatgttacttagtgccttaaagataatatttgaaaaattaaaaaaattattaatacactgtactactatataatatttgacatatatttaacatgattttctattgaaaatttgtatttattattttttaatcaaaacccataaggcattaatttacaagacccatttttcatttatagctttacctgtgatcatttatagctttaagggacttagatgttacaatcttaattacaagtaaatatttatgaaaaacatgtgtcttaccccttaaccttacctcaacaaagaaagtgtgataagtggcaacacacgtgttgcttttttggcccagcaataacacgtgtttttgtggtgtacaaaaatggacaggaatggagttatttaagaggtggtctcacaactgtggatcgtgactatggttggatcaataacattcaccatgacattggcacccatgttattcaccatcttttccctcaaattcctcattatcacctcgttgaagcggtatattttactattattactcacctaaaaagaatgcaattagtacatttgttttatctcttggaagttagtcattttcagttgcatgattgtaatgttctctctatttttaaaccatgttttcacacctacttcgtttaaaataagaatgtggatactattctaatttctattaacttcttttaaaaaataatgtaaaactagtattaaaaaagaggaaatagattacactctactaatactaatagtataaaaaaaattacattgttattttatcacaaataattatatataattaatttttacaatcattatcttaaaagtcatgtatgatatacagtttttacatgctttggtacttattgtaaagttagtgatttattcattatttatgttatataattggcataaatatcatgtaaccagctcactatactataatgggaacttggtggtgaaaggggtttacaaccctcttttctaggtgtaggtgctttgatacttctggtccctttttatatcaatataaattatattttgctgataaaaaaaacattattaatatataatcattaacttctttaaaaaccgtacctaaaactttatattattaaaaagaagattgagatcagcaaaagaaaaaaaaattaacagtcatttgaattcactgcagacacaagcagcaaaatcagttcttggagagtattaccgtgagccagaaagatctgcaccattaccatttcatctaataaagtatttaattcagagtatgagacaagaccacttcgtaagtgacactggagatgtggtttattatcagactgattctctgcaccttcactcgcaccgagactga

SEQ ID NO: 104 - DNA, 3825 bp, Artificial; identical to SEQ ID NO: 74
  Gm183-5-(2,4,5,7,9) T1 FAD3A Allele #1 (SEQ ID NO: 104)

SEQ ID NO: 105 - DNA, 3864 bp, Artificial; identical to SEQ ID NO: 67
  Gm183-6-1 T1 FAD3A Allele #1 (SEQ ID NO: 105)

SEQ ID NO: 106 - DNA, 3864 bp, Artificial; identical to SEQ ID NO: 67
  Gm184-3-20 T1 FAD3A Allele #1 (SEQ ID NO: 106)

SEQ ID NO: 107 - protein, 9 aa, Artificial
  Consensus
LAGLIDADG

SEQ ID NO: 108 - DNA, 70 bp, Glycine Max
  FAD2-1B -23 bp mutant
agcacttttagtcccttatttctcatggaaaataagccatcgcccttgaccgtgatgaagtgtttgtccc

SEQ ID NO: 109 - DNA, 721 bp, Artificial
  Glycine max FAD3A mutation created with TALEN pair GmFAD3_T01.1
cactgctttgttatgcctacctcatttcatttggctttagacaacttaaatttgagatctttattatgtttttgcttatatggtaaagtgattcattcttcacattgaattggctttcagacagcccttttctaatagcctggtgggacacatcttgcattcctcaattcttgtgccataccatggatggttagttcatcccggctttttgtttgtcattggaagttcttttattgattcaattttatagcgtgttcggaaacgcgtttcagaaaataatgaaatacatcttgaatctgaaagttataacttttagcttcattgtcattgaaagttcttttattaattatattttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaaggaatctttatacttcagataaagctgttcttgaacatttttttgtcattatcttagttaaccgagaagt

SEQ ID NO: 110 - DNA, 610 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaataatgaaatacatcttgaatctgaaagttataacttttagcttcattgtcattgaaagttcttttattaattatatttttattgcgtgtttggaatcccatttgagaatagaatcacgtttaaatgtgaagttataactattaacttttgactaaacttgaaaaatcacattttgatgtggaaccaaatctgatttgagaaccaagttgattttgatggattttgcaggagaattagcccacagaactcaccatcaaaatcatggacacattgagaaggatgaatcctgggttccagtatgtgattaactacttcctctatagttattttgattc

SEQ ID NO: 111 - DNA, 754 bp, Artificial
  Glycine max FAD3A mutation created with TALEN pair GmFAD3_T01.1
cactgctttgttatgcctacctcatttcatttggctttagacaacttaaatttgagatctttattatgtttttgcttatatggtaaagtgattcattcttcacattgaattgaacaggtgctgtgccaggcccacggcttgacccccaccgagcaggtggtggccatcgccagcaatggcggtggcaagcaggcatggaagcttttcagacagcccttttctaaatagcctggtgggacacatcttgcattcctcaattcttgtgccataccatggatggttagttcatcccggctttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaactttgactaaacttgaaaaatcacattttgatgtggaaccaaatctgatttgagaaccaagttgattttgatggattttgcaggagtaattagccacagaactcaccatcaaatcatggacacattgagaaggatgaatcctgggttccagtatgtgattaactacttcctctatagttatttttgattcaattaaatttatttatttaataagttcaagaaaaaggtaatctttata

SEQ ID NO: 112 - DNA, 708 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcatttggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaataatgaaatacatcttgaatctgaaagttataacttttagcttcattgtcattgaaagttcttttattaattatatttttattgcgtgtttggaatcccatttgagaaataagaaatcacgtttaaaatgtgaagttataactattaacttttgactaaacttgaaaaaatcacattttgatgtggaaccaaatctgatttgagaaccaagttgattttgatggattttgcaggagaattagccacagaactcaccatcaaaaatcatggacacattgagaaggatgaatcctgggttccagtatgtgattaactacttcctctatagttattttgattcaattaaatttatttatttaataagttcaagaaaaaggaatctttatacttcagataaagctgttcttgaacatttttttgtcattatcttag

SEQ ID NO: 113 - DNA, 681 bp, Artificial
  Glycine max FAD3A mutation created with TALEN pair GmFAD3_T01.1
cactgctttgttatgcctacgccatgtaagttgctttgttaccgcttaactgggcaacaatgctctccaccgccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaataatgaaatacatcttgaatctgaaagttataacttttagcttcattgtcattgaaagttcttttattaattatatttttattgcgtgtttggaatcccatttgagaaataagaaatcacgtttaaatgtgaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaggaatctttatacttcagataaagctgttcttgaacatttttttgtcattatcttagttaa

SEQ ID NO: 114 - DNA, 555 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaacatggaagcttttcagacagcccttttctaaatagcctggtgggacacatcttgcattcctcaattcttgtgccataccatggatggttagttcatcccggcttttttgtttgtcattggaagttcttttattgattcaattttatagcgtgttcggaaacgcgtttcagaaaataatgaaatacatcttgaatctgaaagttataacttttagcttcattgtcattgaaaagttcttttattaattatattttattgcgtgtttggaatcccatttgagaataagaaatcacgtttaaaatgtgaaagttataactattaacttttgactaaacttgaaaaaactcacattttgatgtggaaccaaatctgatttgagaaccaagttgatttgatggattttgcaggagaattagccacagaactcaccatcaaaatca

SEQ ID NO: 115 - DNA, 705 bp, Artificial
  Glycine max FAD3A mutation created with TALEN pair GmFAD3_T01.1
  misc_feature (644): n is a or c or t or g
cactgctttgttatgcctacctcatttcatttggctttagacaacttaaatttgagatctttattatgttttttgcttatatggtaaagtgattcattcttcacattgaattgaacatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttcttttattaattatattttattgcgtgtttggaatcccatttgagaaataagaaatcacgtttaaaatgtgaaagttataactattaacttttgactaaacttgaaaaaatcacattttgatgtggaaccaaatctgatttgagaaccaagttgatttgatggattttgcaggagaattagccacagaactcaccatcaaaatcatggacacattgagaaggatgaatcctgggttccagtatgtgattaactacttcctctatagttattttgattcaattaaatttatttnttaataagtcaagaaaaaaggaatctttatactcagataaagctgtcttgaacattttttt

SEQ ID NO: 116 - DNA, 680 bp, Artificial
  Glycine max FAD3A mutation created with TALEN pair GmFAD3_T01.1
cactgctttgttatgcctacgccatgtaagttgctttgttaccgcttaactgggcaacaatgctctccaccgccatggaagctttcagacagccctttctaatagcctggtgggacacatcttgcattcctcaattcttgtgccataccatggatggttagttcatcccggctttttgtttgtcattggaagttcttttattgattcaatttttatagcgtgttcggaaacgcgtttcagaaataatgaaatacatcttgaatctgaaagttataacttttagcttcattgtcattgaaagttcttttattaattatatttttattgcgtgtttggaatcccatttgagaaataagaaatcacgtttaaatgtgaagttataactattaacttttgactaaacttgaaaaaatcacattttgatgtggaaccaaatctgatttgagaaccaagttgattttgatggattttgcaggagaattagccacagaactcaccatcaaaaatcatggacacatttgagaaggatgaatcctgggttccagtatgtgattaactacttcctctatagttattttgattcaattaaatttatttatttaataagttcaagaaaaaaggaatctttatacttcagataaagctgttcttgaacatttttttgtcattatcttagttaa

SEQ ID NO: 117 - DNA, 713 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaagccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttattaataagttcaagaaaaagggaatctttatacttcagataaagctgttcttgaacattttttt

SEQ ID NO: 118 - DNA, 731 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatattttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttattaataagttcaagaaaaaggaatctttatacttcagataaagctgttcttgaacatttttttgtcattatcttagttaaccgag

SEQ ID NO: 119 - DNA, 714 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaataatgaaatacatcttgaatctgaaagttataacttttagcttcattgtcattgaaagttcttttattaattatatttttattgcgtgtttggaatcccatttgagaaataagaaatcacgtttaaaatgtgaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaatttaatttatttatttaataagttcaagaaaaaggaatctttatacttcagataaagctgttcttgaacatttttttgtcattattcttagttaaccgag

SEQ ID NO: 120 - DNA, 705 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcatttggccatggaagcttttcagacagcccttttctaaatagcctggtgggacacatcttgcattcctcaattcttgtgccataccatggatgggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaaatttatttatttaaataagttcaagaaaaaaatgggaaattctttatacttcagataaagctgttcttgaacattttttt

SEQ ID NO: 121 - DNA, 616 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaagaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatattttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagtta

SEQ ID NO: 122 - DNA, 727 bp, Artificial
  Glycine max FAD3A mutation created with TALEN pair GmFAD3_T01.1
  misc_feature (671): n is a or c or t or g
cactgctttgttatgcctacctcatttcatttggctttagacaacttaaatttgagatctttattatgttttttgcttatatggtaaagtgattcattcttcacattgaattgaagaagcttttcagacagcccttttctaaatagcctggtgggacacatcttgcattcctcaattcttgtgccataccatggatggttagttcatcccggctttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatattttattgcgtgtttggaatcccatttgagaaataagaaatcacgtttaaaaattgtgaaagttataactattaacttttgactaaacttgaaaaaactcacatttttgatgtggaaccaaatctgatttgagaaccaagttgatttgatggattttgcaggagaattagccacagaactcaccatcaaaatcatggacacattgagaaggatgaatcctgggttccagtatgtgattaactacttcctctatagttattttgattcaattaaatttattattaataagttcaagaaaaaggaatcttntactcagataaagctgttcttgaacatttttttagtcattatcttagttaaccgag

SEQ ID NO: 123 - DNA, 734 bp, Artificial
  Glycine max FAD3A mutation created with TALEN pair GmFAD3_T01.1
  misc_feature (675): n is a or c or t or g
cactgctttgttatgcctacctcatttcatttggctttagacaacttaaatttgagatctttattatgttttttgcttatatggtaaagtgattcattcttcacattgaattgaccatggaagcttttcagacagcccttttctaaatagcctggtgggacacatcttgcattcctcaattcttgtgccataccatggatggttagttcatcccggcttttttgtttgtcattggaagttcttttattgattcaattttatagcgtgttcggaaacgcgtttcagaaaataatgaaatacatcttgaatctgaaagttataacttttagcttcattgtcattgaaagttcttttattaattatattttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgatttgatggattttgcaggagaattagccacagaactcaccatcaaaatcatggacacattgagaaggatgaatcctgggtccagtatgtgattaacatacttcctcctatagttattttgattcaattaaatttatttatttaataagttcaagaaaaaaaggaatcttntacttcagataaagctgttcttgaacatttttttgtcattatcttagttaaccgagaag

SEQ ID NO: 124 - DNA, 728 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaagcttttcagacagcccttttctaaatagcctggtgggacacatcttgcattcctcaattcttgtgccataccatggatggttagttcatcccggctttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatattttattgcgtgtttggaatcccatttgagaaataagaaatcacgtttaaaattgtgaaagttataactattaacttttgactaaacttgaaaaaactcacatttttgatgtggaaccaaaatctgatttgagaaccaagttgatttgatggattttgcaggagaattagccacagaactcaccatcaaaatcatggacacattgagaaggatgaatcctgggttccagtatgtgattaactacttcctctatagttattttggattcaattaaatttattattaataagttcaagaaaaagggaatcttatacttcagataaatgctgttcttgaacatttttttagtcattatcttagttaaccgag

SEQ ID NO: 125 - DNA, 737 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaacgccatggaagcttttcagacagcccttttctaaatagcctggtgggacacatcttgcattcctcaattcttgtgccataccatggatggttagttcatcccggcttttttgtttgtcattggaagttcttttattgattcaattttatagcgtgttcggaaacgcgtttcagaaaataatgaaatacatcttgaatctgaaagttataacttttagcttcattgtcattgaaagttcttttattaattatattttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaaagggaatctttatacttcagataaagctgttctgaacatttttttgtcattatcttagttaaccgagaag

SEQ ID NO: 126 - DNA, 734 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaagaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatattttattgcgtgtttggaatcccatttgagaaataagaaatcacgtttaaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagtttcaagaaaaaaagggaatctttatacttcagataaagctgattcttgaacatttttttgtcattatcttagttaaccgag

SEQ ID NO: 127 - DNA, 610 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatattttattgcgtgtttggaatcccatttgagaaattaagaaatcacgtttaaaatgtgaaagttataactattaacttttgactaaacttgaaaaaatcacattttgatgtggaaccaaattctgatttgagaaccaagttgatttgatggattttgcatggagaattagccacagaactcaccattcaaaatcatggacacattgagaaggattgaatcctgggttccagtatgtgattaact

SEQ ID NO: 128 - DNA, 529 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcagacagcccttttctaaatagcctggtgggacacatcttgcattcctcaattcttgtgccataccatggatggttagttcatcccggctttttgtttgtcattggaagttcttttattgattcaatttttatagcgtgttcggaaacgcgtttcagaaataatgaaatacatcttgaatctgaaagttataacttttagcttcattgtcattgaaagttcttttattaattatatttttattgcgtgtttggaatcccatttgagaaataagaaatcacgtttaaaatgtgaagttataactattaactttgactaaacttgaaaaaatcacattttgatgtggaaccaaatctgatttgagaaccaagttgattttgatggattttgcaggagaattagccacagaactcaccatcaaaatcatgg

SEQ ID NO: 129 - DNA, 712 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgagccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaaggaatctttatacttcagataaagctgttcttgaacattttttt

SEQ ID NO: 130 - DNA, 725 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgagcttttcagacagcccttttctaaatagcctggtgggacacatcttgcattcctcaattcttgtgccataccatggatggttagttcatcccggctttttgtttgtcattggaagttcttttattgattcaatttttatagcgtgttcggaaacgcgtttcagaaaataatgaaatacatcttgaatctgaaagttataacttttagcttcattgtcattgaaaagttcttttattaattatattttattgcgtgtttggaatcccatttgagaaataagaaatcacgtttaaaattgtgaaagttataactattaacttttgactaaacttgaaaaaatcacatttttgatgtggaaccaaatctgatttgagaaccaagttgatttgatggattttgcaggagaattagccacagaactcaccatcaaaatcatggacacattgagaaggatgaatcctgggttccagtatgtgattaactacttcctctatagttatttttgattcaattaaatttatttattaataagttcaagaaaaaaggaatctttatacttcagataaagctgttcttgaacatttttttagtcattatcttagttaaccgag

SEQ ID NO: 131 - DNA, 670 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaaccggaccactgtttgccgacgccaacgatcgcttcgtgtgtcgcctctggcaacgctgcgatcatgtcctggttgtagccgccggagtaggccttggtgtccacgatcacgccgtagtcgatgggggagcccacggtgtagatggcgccgtcgggcttcagtggccatggaagcttttcagacagcccttttctaaaatagcctggtgggacacatcttgcattcctcaattcttgtgccataccatggatggttagttcatcccggctttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatattttattgcgtgtttggaatcccatttgagaaataagaaatcacgtttaaaatgtgaaagttataactattaactttgactaaacttgaaaaatcacatttttgatgtggaaccaaatctgatttgagaaccaagttga

SEQ ID NO: 132 - DNA, 711 bp, Artificial
  Glycine max FAD3A mutation created with TALEN pair GmFAD3_T01.1
cactgctttattatgcctacctcatttcatttggctttagacaacttaaatttgagatctttattatgttttttgcttatatggtaaagtgattcattcttcacattgaattcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaggaatctttatacttcagataaagctgttcttgaacatttttttgtcattatcttagttaacc

SEQ ID NO: 133 - DNA, 690 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgatggaagcttttcagacagcccttttctaaatagcctggtgggacacatcttgcattcctcaattcttgtgccataccatggatggttagttcatcccggcttttttgtttgtcattggaagttcttttattgattcaattttatagcgtgttcggaaacgcgtttcagaaaataatgaaatacatcttgaatctgaaagttataacttttagcttcattgtcattgaaagttcttttattaattatattttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaagggaatctttatacttcagataaagctg

SEQ ID NO: 134 - DNA, 780 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaaccggaccactgtttgccgacgccaacgatcgcttcgtgtgtcgcctctggcaacgctgcgatcatgtcctggttgtagccgccggagtaggccttggtgtccacgatcacgccgtagtcgatgggggagcccacggtgtagatggcgccgtcgggcttcagtggccatggaagcttttcagacagcccttttctaaaatagcctggtgggacacatcttgcattcctcaattcttgtgccataccatggatggttagttcatcccggctttttgtttgtcattggaagttcttttattgattcaatttttatagcgtgttcggaaacgcgtttcagaaaataatgaaatacatcttgaatctgaaagttatactttagcttcattgtcattgaaagttcttttattaattatattttattgcgtgtttggaatcccatttgagaaataagaaatcacgtttaaaatgtgaaagttataactattaactttgactaaacttgaaaaatcacatttttgatgtggaaccaaatctgatttgagaaccaagttgatttttgatggattttgcaggagaattagccacagaactcaccatcaaaatcatggacacattgagaaggatgaatcctgggttccagtatgtgattaagctacttcctctat

SEQ ID NO: 135 - DNA, 711 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaccatggaagcttttcagacagcccttttctaaatagcctggtgggacacatcttgcattcctcaattcttgtgccataccatggatggttagttcatcccggcttttttgtttgtcattggaagttcttttattgattcaattttatagcgtgttcggaaacgcgtttcagaaaataatgaaatacatcttgaatctgaaagttataacttttagcttcattgtcattgaaaagttctttttattaattatattttattgcgtgtttggaatcccatttgagaaataagaaatcacgtttaaaaattgtgaaagttataactattaacttttgactaaacttgaaaaaatcacatttttgatgtggaaccaaatctgatttgagaaccaagttgattttgatggattttgcaggagaattagccacagaactcaccatcaaaatcatggatcacattgagaaggatgaatcctgggttccagtatgtgattaactacttcctctatagttattttgattcaattaaatttattattaataagttcaagaaaaaggaatcttatacttcagataaagctgttcttgaacattttttt

SEQ ID NO: 136 - DNA, 739 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaattgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaagggaatctttatacttcagataaagctgttcttgaacattttttttagtcattatcttagttaaccgag

SEQ ID NO: 137 - DNA, 724 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaccgccatcgccagcaatattggtgtcggtggccaccacctgctgagggtcaagccgtgggcctggcacagcaccggcaacaggcgctggagacggccatggaagcttttcagacagcccttttctaaatagcctggtgggacacatcttgcattcctcaattcttgtgccataccatggatggttagttcatcccggctttttgtttgtcattggaagttcttttattgattcaatttttatagcgtgttcggaaacgcgtttcagaaataatgaaatacatcttgaatctgaaagttataactttagcttcattgtcattgaaagttcttttattaattatatttttattgcgtgtttggaatcccatttgagaaataagaaatcacgtttaaaatgtgaaagttataactattaacttttgactaaacttgaaaaaaactcacatttttgatgtggaaccaaatctgatttgagaaccaagttgattttgatggattttgcaggagaattagccacagaactcaccatcaaaatcatggacacattgagaagggatgaatcctgggttccagtatgtgattaactacttcctctatagttatttttt

SEQ ID NO: 138 - DNA, 611 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatattttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagtta

SEQ ID NO: 139 - DNA, 630 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaacgccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatattttattgcgtgtttggaatcccatttgagaaataagaaatcacgtttaaaatgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttt

SEQ ID NO: 140 - DNA, 668 bp, Artificial
  Glycine max FAD3A mutation created with TALEN pair GmFAD3_T01.1
cactgctttgttatgcctacctcatttcatttggctttagacaacttaaatttgagatctttattatgtttttgcttatatggtaaagtgattcattcttcagacagcccttttctaaatagcctggtgggacacatcttgcattcctcaattcttgtgccataccatggatggttagttcatcccggctttttgtttgtcattggaagttcttttattgattcaatttttatagcgtgttcggaaacgcgtttcagaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaactttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaaatttatttatttaataagttcaagaaaaaggaatctttatacttcagataaagctgttcttg

SEQ ID NO: 141 - DNA, 734 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatattttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgatttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaaaggaatctttatacttcagataaagctgttcttgaacatttttttgtcattatcttagttaaccgag

SEQ ID NO: 142 - DNA, 645 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaacgccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatattttattgcgtgtttggaatcccatttgagaaataagaaatcacgtttaaaattgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaattta

SEQ ID NO: 143 - DNA, 726 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaagaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatattttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttattattaataagttcaagaaaaaggaatctttatacttcagataaagctgttcttgaacatttttttgtcattatcttagttaaccgag

SEQ ID NO: 144 - DNA, 729 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatattttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttattattaataagttcaagaaaaaggaatcttatacttcagataaagctgattcttgaacatttttttgtcattatcttagttaaccgag

SEQ ID NO: 145 - DNA, 798 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaaccggaccactgtttgccgacgccaacgatcgcttcgtgtgtcgcctctggcaacgctgcgatcatgtcctggttgtagccgccggagtaggccttggtgtccacgatcacgccgtagtcgatgggggagccacggtgtagatggcgccgtcgggcttcagtggccatggaagcttttcagacagcccttttctaaaatagcctggtgggacacatcttgcattcctcaattcttgtgccataccatggatggttagttcatcccggctttttgtttgtcattggaagttcttttattgattcaatttttatagcgtgttcggaaacgcgtttcagaaaattaatgaaatacatcttgaatctgaaagttataacttttagcttcattgtcattgaaagttcttttattaattatattttattgcgtgtttggaatcccatttgagaaataagaaatcacgtttaaaatgtgaaagttataactattaactttgactaaacttgaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaagctacttcctctatagttatttttgattcaa

SEQ ID NO: 146 - DNA, 729 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaagaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatattttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaaggaatctttatacttcagataaagctgttcttgaacatttttttgtcattatcttagttaaccgag

SEQ ID NO: 147 - DNA, 729 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaaccggaccactgtttgccgacgccaacgatcgcttcgtgtgtcgcctctggcaacgctgcgatcatgtcctggttgtagccgccggagtaggccttggtgtccacgatcacgccgtagtcgatgggggagcccacggtgtagatggcgccgtcgggcttcagtggccatggaagcttttcagacagcccttttctaaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatattttattgcgtgtttggaatcccatttgagaaataagaaatcacgtttaaaatgtgaaagttataactattaactttgactaaacttgaaaaatcacatttttgatgtggaaccaaatctgatttgagaaccaagttgattttgatggattttgcaggagaattagccacagaactcaccatcaaaatcatggacac

SEQ ID NO: 148 - DNA, 709 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgatttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaaatcatggacacattgagaaggatgaatcctgggttccagtatgtgattaactacttcctctatagttatttttgattcaattaaaatttatttatttaaataagttcaagaaaaaaggaatctttatacttcagataaagctgttcttgaacatttttttgtcatta

SEQ ID NO: 149 - DNA, 694 bp, Artificial
  Glycine max FAD3A mutation created with TALEN pair GmFAD3_T01.1
  misc_feature (143): n is a or c or t or g
cactgctttgttatgcctacctcatttcatttggctttagacaacttaaatttgagatctttattatgttttttgcttatatggtaaagtgattcattcttcacattgaattgccatggaagcttttcagacagcccttttcnaaatagcctggtgggacacatcttgcattcctcaattcttgtgccataccatggatggttagttcatcccggcttttttgtttgtcattggaagttcttttattgattcaattttatagcgtgttcggaaacgcgttcagaaaataagaaatacatcttgaatctgaaagttataacttttagcttcattgtcattgaaagttctttttattaattatatttttattgcgtgtttggaatcccatttgagaaataagaaatcacgtttaaaaatgtgaaagttataactattaacttttgactaaacttgaaaaaatcacatttttgatgtggaaccaaatctgattgagaaccaagttgttttgatggattttgcaggagaattagccacagaactcaccatcaaaatcatggacacatgagaaggatgaatcctgggttccagtatgtgattaactacttcctctatagttattttgattcaattaaatttatttatttaataagttcaagaaaaaaagggaatctttatacttcagataaagctgttc

SEQ ID NO: 150 - DNA, 638 bp, Artificial
  Glycine max FAD3A mutation created with TALEN pair GmFAD3_T01.1
  misc_feature (637): n is a or c or t or g
cactgctttgttatgcctacctcatttcatttggctttagacaacttaaatttgagatctttattatgtttttattatcttttcagacagccctttctaaatagcctggtgggacacatcttgcattcctcaattcttgtgccataccatggatggttagttcatcccggcttttttgtttgtcattggaagttcttttattgattcaatttttatagcgtgttcggaaacgcgttttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaatttagccacagaactcaccatcaaaatcatggacacattgagaaggatgaatcctgggttccagtatgtgattaactacttcctctatagttatttttgattcaattaaatttatttatttaataagttcaagaaaaaatggaatctttatnc

SEQ ID NO: 151 - DNA, 702 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcatttggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaataatgaaatacatcttgaatctgaaagttataacttttagcttcattgtcattgaaaagttcttttattaattatatttttattgcgtgtttggaatcccatttgagaaataagaaatcacgtttaaaatgtgaagttataactattaacttttgactaaacttgaaaaaatcacattttgatgtggaaccaaatctgatttgagaaccaagttgattttgatggattttgcaggagaattagccacagaactcaccatcaaaaatcatggacacattgagaaggatgaatcctgggttccagtatgtgattaactacttcctctatagttattttgattcaattaaatttattatttaataagttcaagaaaaaggaatctttatacttcagataaagctgttcttgaacatttttttgtcatta

SEQ ID NO: 152 - DNA, 725 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaacatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttattattaataagttcaagaaaaaggaatcttatacttcagataaagctgttcttgaacatttttttgtcattatcttagttaaccgag

SEQ ID NO: 153 - DNA, 713 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgatggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgatttgatggattttgcaggagaattagccacagaactcaccatcaaaatcatggacacattgagaaggatgaatcctgggttccagtatgtgattaactacttcctctatagttattttgattcaattaaatttatttattaataagttcaagaaaaaggaatctttatacttcagataaagctgttcttgaacatttttttt

SEQ ID NO: 154 - DNA, 706 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatattttattgcgtgtttggaatcccatttgagaaataagaaatcacgtttaaaattgtgaaagttataactattaacttttgactaaacttgaaaaaatcacatttttgatgtggaaccaaatctgatttgagaaccaagttgatttgatggattttgcaggagaattagccacagaactcaccatcaaaatcatggacacattgagaaggatgaatcctgggttccagtatgtgattaactacttcctctatagttattttgattcaattaaatttattattaataagttcaagaaaaagggaatctttatacttcagataaagctgttcttgaacatttttt

SEQ ID NO: 155 - DNA, 725 bp, Artificial
  Glycine max FAD3A mutation created with TALEN pair GmFAD3_T01.1
  misc_feature (437): n is a or c or t or g
cactgctttgttatgcctacctcatttcatttggctttagacaacttaaatttgagatctttattatgttttttgcttatatggtaaagtgattcattcttcacattgaattgagcttttcagacagcccttttctaaatagcctggtgggacacatcttgcattcctcaattcttgtgccataccatggatggttagttcatcccggcttttttgtttgtcattggaagttcttttattgattcaattttatagcgtgttcggaaacgcgtttcagaaaataatgaaatacatcttgaatctgaaagttataacttttagcttcattgtcattgaaagttcttttataattatattttattgcgtgtttggaatcccatttgagaaataagaaatcacgtttaaaaattgtgaaagttataactattaacttttgnctaaaacttgaaaaaactcacatttttgatgtggaaccaaatctgatttgagaaccaagttgatttgatggattttgcaggagaattagccacagaactcaccatcaaaatcatggacacattgagaaggatgaatcctgggttccagtatgtgattaactacttcctctatagttatttttgattcaattaaatttatttattaataagttcaagaaaaaagggaatcttatacttcagataaagctgttcttgaacatttttttagtcattatcttagtaaccgag

SEQ ID NO: 156 - DNA, 622 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaatttcatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatattttattgcgtgtttggaatcccatttgagaaattaagaaatcacgtttaaaattgtgaaagttataactatactttagatctaaacttgaaaaaactcacatttttgatgtggaaccaaatctgatttgagaaccaagttgatttgatggatttgcaggagaattagccacagaactcaccatcaaaatcatggacacattgagaaggattgaatcctgggttccagtatgtgattaactacttcctctatagtta

SEQ ID NO: 157 - DNA, 707 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatattttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaagggaatctttatacttcagataaagctgttcttgaacatttttttt

SEQ ID NO: 158 - DNA, 535 bp, Artificial
  Glycine max FAD3A mutation created with TALEN pair GmFAD3_T01.1
cactgctttgttatgcctacctcattccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggatttttgcaggagaattagccacagaactcaccatcaaaatcatggacacattgagaaggatgaattcctgggttccagtatgtgattaactacttcctctatagtta

SEQ ID NO: 159 - DNA, 736 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatattttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaaatttatttatttaataagttcaagaaaaaaagggaatctttatacttcagataaagctgttcttgaacattttttttagtcattatcttagttaaccgag

SEQ ID NO: 160 - DNA, 741 bp, Artificial
  Glycine max FAD3A mutation created with TALEN pair GmFAD3_T01.1
  misc_feature (684): n is a or c or t or g
cactgctttgttatgcctacctcatttcatttggctttagacaacttaaatttgagatctttattatgttttttgcttatatggtaaagtgattcattcttcacattgaattgaagccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggtccagtatgtgattaacatacttcctcctatagttattttgattcaattaaatttatttatttaattaagttcaagaaaaaaagggaatctttntacttcagataaagctgttcttgaaaattttttttgtcattatcttagttaaccgag

SEQ ID NO: 161 - DNA, 472 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaccgctgcaccgtctccagcgcctgcttgccaccatgtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaaatacatcttgaatctgaaaagttataacttttagcttcattgtcattgaaagttcttttattaattatattttattgcgtgtttggaatcccatttgagaaataagaaatcacgtttaaaatgtgaaagttat

SEQ ID NO: 162 - DNA, 711 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttattaataagttcaagaaaaaggaatcttatacttcagataaagctgttcttgaacatttttttt

SEQ ID NO: 163 - DNA, 625 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaacccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatattttattgcgtgtttggaatcccatttgagaaataagaaatcacgtttaaaatgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagtta

SEQ ID NO: 164 - DNA, 721 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcatttggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaataatgaaatacatcttgaatctgaaagttataacttttagcttcattgtcattgaaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaaatcatggacacattgagaaggatgaatcctgggttccagtatgtgattaactacttcctctatagttattttgattcaattaaatttatttatttaataagttcaagaaaaaaggaatctttatacttcagataaagctgttcttgaacattttttttgtcattatcttagttaaccgag

SEQ ID NO: 165 - DNA, 624 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaagcatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagtta

SEQ ID NO: 166 - DNA, 714 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaaggaatctttatacttcagataaagctgttcttgaacattttttt

SEQ ID NO: 167 - DNA, 609 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgacatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaataatgaaatacatcttgaatctgaaagttataacttttagcttcttgtcattgaaagttctttttattaattatatttttattgcgtgtttggaatcccatttgagaaataagaaatcacgtttaaaattgtgaaagttataactattaacttttgactaaacttgaaaaaatcacattttgatgtggaaccaaatctgattttgagaaccaagttgaattttgatggattttgcatggagaattagccacagaactcaccatcaaaatcatggacacattgagaaggatgaatcctgggttccagtatgtgattaactac

SEQ ID NO: 168 - DNA, 712 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttattaataagttcaagaaaaaggaatcttatacttcagataaagctgttcttgaacattttttt

SEQ ID NO: 169 - DNA, 732 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaatccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatattttattgcgtgtttggaatcccatttgagaaataagaaatcacgtttaaaattgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttattaataagttcaagaaaaaggaatcttatacttcagataaagctgttcttgaacatttttttagtcattatcttagtaaccgagaag

SEQ ID NO: 170 - DNA, 711 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatattttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaaggaatctttatacttcagataaagctgttcttgaacattttttt

SEQ ID NO: 171 - DNA, 724 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatattttattgcgtgtttggaatcccatttgagaaataagaaatcacgtttaaaaatgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttattattaataagttcaagaaaaaggaatcttatacttcagataaagctgttcttgaacatttttttagtcattatcttagttaaccgag

SEQ ID NO: 172 - DNA, 716 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcatttggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaataatgaaatacatcttgaatctgaaagttataacttttagcttcattgtcattgaaagttcttttattaattatatttttattgcgtgtttggaatcccatttgagaaataagaaatcacgtttaaaatgtgaagttataactattaacttttgactaaacttgaaaaaatcacattttgatgtggaaccaaatctgatttgagaaccaagttgattttgatggattttgcaggagaattagccacagaactcaccatcaaaaatcatggacacattgagaaggatgaatcctgggttccagtatgtgattaactacttcctctatagttatttttgattcaattaaaatttatttatttaataagttcaagaaaaaaggaatctttatacttcagataaagctgttcttgaacattttttttgtcattatcttagttaa

SEQ ID NO: 173 - DNA, 731 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatattttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttattattaataagttcaagaaaaaggaatcttatacttcagataaagctgttcttgaacatttttttagtcattatcttagttaaccgag

SEQ ID NO: 174 - DNA, 724 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacatcatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatattttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttattaataagttcaagaaaaaaggaatctttatacttcagataaagctgttcttgaacattttttttgtcattatcttagttaaccgag

SEQ ID NO: 175 - DNA, 715 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaatcatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataaacttttagcttcattgtcattgaaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttattattaataagttcaagaaaaaggaatcttatacttcagataaagctgttcttgaacatttttttgtgattatc

SEQ ID NO: 176 - DNA, 735 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttattaataagttcaagaaaaaggaatcttatacttcagataaagctgttcttgaacatttttttagtcattatcttagttaaccgag

SEQ ID NO: 177 - DNA, 644 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaatgtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatattttattgcgtgtttggaatcccatttgagaaataagaaatcacgtttaaaatgtgaaagttataactattaacttttgactaaacttgaaaaaatcacatttttgatgtggaaccaaatctgattttgagaaccaagttgattttgatggattttgcaggagaattagccacagaactcaccatcaaaatcatggacacattgagaaggatgaatcctgggttccagtatgtgattaactacttcctctatagttattttgattcaattaaattta

SEQ ID NO: 178 - DNA, 732 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgggccatggaagcttttcagacagcccttttctaaatagcctggtgggacacatcttgcattcctcaattcttgtgccataccatggatggttagttcatcccggcttttttgtttgtcattggaagttcttttattgattcaattttatagcgtgttcggaaacgcgtttcagaaaataatgaaatacatcttgaatctgaaagttataacttttagcttcattgtcattgaaagttctttttattaattatattttattgcgtgtttggaatcccatttgagaaataagaaatcacgtttaaaaattgtgaaagttataactattaacttttgactaaacttgaaaaaactcacatttttgatgtggaaccaaatctgatttgagaaccaagttgatttgatggattttgcaggagaattagccacagaactcaccatcaaaatcatggacacattgagaaggatgaatcctgggttccagtatgtgattaactacttcctctatagttattttgattcaattaaatttattattaataagttcaagaaaaaggaatcttatacttcagataaagctgttcttgaacatttttttagtcattatcttagttaaccgag

SEQ ID NO: 179 - DNA, 724 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaacatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatattttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaatttattattaataagttcaagaaaaaggaatcttatacttcagataaagctgttcttgaacatttttttagtcattatcttagttaa

SEQ ID NO: 180 - DNA, 659 bp, Artificial
  Glycine max FAD3A mutation created with TALEN pair GmFAD3_T01.1
cactgctttgttatgcctacctcatttcatttggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaataatgaaatacatcttgaatctgaaagttataacttttagcttcattgtcattgaaagttcttttattaattatatttttattgcgtgtttggaatcccatttgagaaataagaaatcacgtttaaaatgtgaaaagttataactattaacttttgactaaaacttgaaaaaatcacatttttgatgtggaaccaaatctgatttgatgaaccaagttgattttgatggattttgcaggagaattagccacagaactcaccatcaaaatcatggacacattgagaaggatgaattcctgggttccagtatgtgattaactacttcctctatagttattttgattcaattaaatttatttatttaataatgtttcaagaaaaaaaggaatctttatacttcagataaagctgttcttgaacatttttttgtcattatcttagttaaccgag

SEQ ID NO: 181 - DNA, 712 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatattttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaggaatctttatacttcagataaagctgttcttgaacatttttttt

SEQ ID NO: 182 - DNA, 709 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaacaagcttttcagacagcccttttctaaatagcctggtgggacacatcttgcattcctcaattcttgtgccataccatggatggttagttcatcccggcttttttgtttgtcattggaagttcttttattgattcaattttatagcgtgttcggaaacgcgtttcagaaaataatgaaatacatcttgaatctgaaagttataacttttagcttcattgtcattgaaagttctttttattaattatattttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaaagggaatctttatacttcagataaagctgttcttgaacatttttttt

SEQ ID NO: 183 - DNA, 664 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaacacatcttgcattcctcaattcttgtgccataccatggatggttagttcatcccggcttttttgctttgttctattggaagttcttttattgatttcaatttttattagcgtgttcggaaacgacgttttcagaaaataatgaaatacatcttgaatctgaaagttataacttttagcttcattgtcattgaaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagtaaccaagtttgatttttgatggatttttgcaggagaattagccacagaactcaccaatcaaaatcatggacacatttgagaaggatgaatcctgggttccagtatgtgattaactacttcctctatagttattttgattcaattaaatttatttatttaataagttcaagaaaaaggaatctttatacttcagataaagctgtt

SEQ ID NO: 184 - DNA, 769 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcaccattattgctggcgatggccaccggggtgcctaatgagtgagctaactcacattaattgcgttgcgctcactgcccgctggccatggaagcttttcagacagcccttttctaaatagcctggtgggacacatcttgcattcctcaattcttgtgccataccatggatggttagttcatcccggctttttgtttgtcattggaagttcttttattgattcaattttatagcgtgttcggaaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatgggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaagggaatctttatacttcagataaagctgttc

SEQ ID NO: 185 - DNA, 629 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaccatggaagcttttcagacagcccttttctaaatagcctggtgggacacatcttgcattcctcaattcttgtgccataccatggatggttagttcatcccggcttttttgtttgttcattggaagttcttttattgattcaatttttatagcgtgttcggaaacgcgtttcagaaaataatgaaatacatcttgaatctgaaagttataacttttagcttcattgtcattgaaaagttctttttattaattatattttattgcgtgtttggaatcccatttgagaaataagaaatcacgtttaaaattgtgaaagttataactattaacttttgactaaacttgaaaaaactcacatttttgatgtggaaccaaatctgattttgagaaccaagttgattttgatggattttgcaggagaattagccacagaactcaccatcaaaatcatggacacattgagaaggattgaatcctgggttccagtatgtgattaactacttcctctatagtta

SEQ ID NO: 186 - DNA, 744 bp, Artificial
  Glycine max FAD3A mutation created with TALEN pair GmFAD3_T01.1
  misc_feature (690): n is a or c or t or g
cactgctttgttatgcctacctcatttcatttggctttagacaacttaaatttgagatctttattatgttttttgcttatatggtaaagtgattcattcttcacattgaattgaacagacagtggccatggaagcttttcagacagcccttttctaaatagcctggtgggacacatcttgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttntacttcagataaagctgttcttgaacattttttttgtcattatctagttaaccg

SEQ ID NO: 187 - DNA, 730 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaaaggaatctttatacttcagataaagctgttcttgaacatttttttgtcattatcttagttaa

SEQ ID NO: 188 - DNA, 619 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaatgccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaataagaaatcacgtttaaaattgtgaaagttataactattaacttttgactaaacttgaaaaaactcacatttttgatgtggaaccaaatctgatttgagaaccaagttgattttgatggattttgcaggagaattagccacagactcaccatcaaaatcatggacacattgagaaggattgaatcctgggttccagtatgtgattaactacttcctctatag

SEQ ID NO: 189 - DNA, 737 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaaggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatattttattgcgtgtttggaatcccatttgagaaataagaaatcacgtttaaaattgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaggaatctttatacttcagataaagctgttcttgaacattttttttagtcattatcttagttaaccgagaag

SEQ ID NO: 190 - DNA, 724 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatattttattgcgtgtttggaatcccatttgagaaataagaaatcacgtttaaaaattgtgaaagttataactattaacttttgactaaacttgaaaaaactcacatttttgatgtggaaccaaatctgatttgagaaccaagttgatttgatggattttgcaggagaattagccacagaactcaccatcaaaatcatggacacattgagaaggatgaatcctgggttccagtatgtgattaactacttcctctatagttattttgattcaattaaatttattattaataagttcaagaaaaaggaatcttatacttcagataaagctgttcttgaacatttttttagtcattatcttagttaaccgag

SEQ ID NO: 191 - DNA, 733 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatattttattgcgtgtttggaatcccatttgagaaataagaaatcacgtttaaaatgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaagggaatctttatacttcagataaagctgttcttgaacatttttttagtcattatcttagttaaccgag

SEQ ID NO: 192 - DNA, 681 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattttgcattcctcaattcttgtgccataccatggatggttagttcatcccggctttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaaagttataactattaacttttgactaaacttgaaaaaatcacatttttgatgtggaaccaaatctgattgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaatggaatctttatacttcagataaagctgtcttgaacatttttttttgtcattatctagtttaaccgagaag

SEQ ID NO: 193 - DNA, 738 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaaagggaatctttatacttcagataaagctgttcttgaacattttttttgtcattatcttagttaaccgag

SEQ ID NO: 194 - DNA, 803 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaatgctgaggggtcaagccgtgggcctggcacagcaccggcaacagccgctggaccgtctccagtggccatggaagcttttcagacagcccttttctaaatagcctggtgggacacatcttgcattcctcaattcttgtgccataccatggatggttagttcatcccggctttttgtttgtcattggaagttcttttattgattcaatttttatagcgtgttcggaaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttattaataagttcaagaaaaagggaatctttatacttcagataagctgttcttgaacatttttttttagtcattattctagtttaaccgagaa

SEQ ID NO: 195 - DNA, 721 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaacaccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaaattgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaaatttatttatttaataagttcaagaaaaaaagggaatctttatacttcagataaagctgtcttgaacatttttttt

SEQ ID NO: 196 - DNA, 650 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaacaatggccaccacctgctgggggtgcaagccgtgggcctggcacagcaccggcaacagccgctggaccgtctccagcgcctgcttgccgccatttggccatggaagcttttcagacagcccttttctaaatagcctggtgggacacatcttgcattcctcaattcttgtgccataccatggatggttagttcatcccggctttttgtttgtcattggaagttcttttattgattcaatttttatagcgtgttcggaaaacgcgtttcagaaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaattcacatttttgatgtggaaccaaatctgatttgagaaccaagttgattttgatggattttgcaggagaattagccacagaactcacca

SEQ ID NO: 197 - DNA, 691 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgatccctttttcactgcatccagcgcaggacgcccgccgaggcaggccaaggcgacgaggtggtcgttggtcaacgcggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaagtcacatttttgatgtggaaccaaatctgatttgagaaccaagttgattttgatggattttgcaggagaattagccacagaactcaccatcaaaatcatggacacattgagaaggatgaatcctgggtttccagtatgtgattaactactt

SEQ ID NO: 198 - DNA, 464 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatattttattgcgtgtttggaatcccatttgagaataagaaatcacgtttaaaatgtgaaagttataactattaacttttgactaaacttgaaaaaatcaca

SEQ ID NO: 199 - DNA, 568 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaacatggaagcttttcagacagcccttttctaaatagcctggtgggacacatcttgcattcctcaattcttgtgccataccatggatggttagttcatcccggcttttttgtttgtcattggaagttcttttattgattcaattttatagcgtgttcggaaacgcgttcagaaaataatgaaatacatcttgaatctgaaagttataacttttagcttcattgtcattgaaagttcttttattaattatattttattgcgtgtttggaatcccatttgagaataagaaatcacgtttaaaatgtgaaagttataactattaacttttgactaaacttgaaaaaatcacattttgatgtggaaccaaatctgatttgagaaccaagttgatttgatggatttgcagagaattagccacagaactcaccatcaaaatcatggacacattgagaagga

SEQ ID NO: 200 - DNA, 700 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcatttggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaataatgaaatacatcttgaatctgaaagttataacttttagcttcattgtcattgaaagttcttttattaattatatttttattgcgtgtttggaatcccatttgagaaataagaaatcacgtttaaatgtgaagttataactattaactttgactaaacttgaaaaaatcacattttgatgtggaaccaaatctgatttgagaaccaagttgattttgatggattttgcaggagaattagccacagaactcaccatcaaaaatcatggacacattgagaaggatgaatcctgggttccagtatgtgattaactacttcctctatagttattttgattcaattaaatttatttatttaataagttcaagaaaaaggaatctttatacttcagataaagctgttcttgaacatttttttgtcatta

SEQ ID NO: 201 - DNA, 708 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgacatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatattttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgaattttgatggattttgcaggagaattagccacagaactcaccatcaaaatcatggacacattgagaaggatgaatcctgggttccagtatgtgattaactacttcctctatagttattttgattcaattaaatttattattaataagttcaagaaaaaggaatcttatacttcagataaagctgttcttgaacattttttt

SEQ ID NO: 202 - DNA, 625 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaattgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagtta

SEQ ID NO: 203 - DNA, 713 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaagccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttattaataagttcaagaaaaaggaatctttatacttcagataaagctgttcttgaacatttttttt

SEQ ID NO: 204 - DNA, 739 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaattgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttattattaataagttcaagaaaaagggaatctttatacttcagataaagctgttcttgaacattttttttagtcattatcttagttaaccgag

SEQ ID NO: 205 - DNA, 742 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaaattgtgaaagttataactattagctttaattcttaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaagggaatctttatacttcagataaagctgttcttgaacattttttttagtcattatcttagttaaccgag

SEQ ID NO: 206 - DNA, 690 bp, Artificial
  Glycine max FAD3A mutation created with TALEN pair GmFAD3_T01.1
cactgctttgttatgcctacctcatttcatttggctttagacaacttaaatttgagatctttcatttggccatggaagcttttcagacagccctttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaatcacatttttgatgtggaaccaaatctgattgagaaccagttgattttgatggattttgcaggagaattagccacatgaactcaccatcaaaatcatggacacattgagaaggatgaatcctgggttccagtatgtgattaactacttcctctatagttatttttgattcaattaatttatttatttaataagttcaagaaaaaggaatctttatacttcagataaagctgttcttgaacattttttttgtcattatcttagtttaaccgagaag

SEQ ID NO: 207 - DNA, 624 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatattttattgcgtgtttggaatcccatttgagaaataagaaatcacgtttaaaaatgtgaaagttataactattaacttttgactaaacttgaaaaaactcacatttttgatgtggaaccaaatctgatttgagaaccaagttgatttgatggattttgcaggagaattagccacagaactcaccatcaaaatcaggacacattgagaaggattgaatcctgggattccagtatagtgattaactacttcctctatagtta

SEQ ID NO: 208 - DNA, 619 bp, Artificial
  Glycine max FAD3A mutation created with TALEN pair GmFAD3_T01.1
cactgctttgttatgcctacctcatttcatttggctttagacaacttaaatttgagatctttattcagacagcccttttctaaatagcctggtgggacacatcttgcattcctcaattcttgtgccataccatggatggttagttcatcccggcttttttgtttgtcattggaagttcttttattgattcaatttttatagcgtgttcggaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaaagttataactattaacttttgactaaacttgaaaaaatcacatttttgatgtggaaccaaatctgattgagaaccaagttgattttgatggattttgcaggagaatttagccacatgaactcaccatcaaaatcatggacacattgagaaggatgaatcctgggttccagtatgtgattaactacttcctctatagttatttttgattcaattaatttatttatttaataagttcaagaaaaaatggaatctttatac

SEQ ID NO: 209 - DNA, 684 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgatttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaagttataactattaacttttgactaaacttgaaaaaatcacattttgatgtggaaccaaatctgatttgagaaccaagttgattttgatggattttgcaggagaattagccacagaactcaccatcaaaaatcatggacacattgagaaggatgaatcctgggttccagtatgtgattaactacttcctctatagttattttgattcaattaaatttatttatttaataagttcaagaaaaaaggaatctttatacttcagataaagctgtt

SEQ ID NO: 210 - DNA, 732 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaacatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataactttttagcttcattgtcattgaaagttctttttattaattatatttttattgcgtgtttggaatcccatttgagaaataagaaatcacgtttaaaattgtgaaagttataactattaacttttgactaaacttgaaaaaactcacatttttgatgtggaaccaaatctgatttgagaaccaagttgattttgatggattttgccaggagaattagccacagaactcaccatcaaaatcatggacacattgagaaggatgaatcctgggttccagtatgtgattaactacttcctctatagttattttgattcaattaaatttatttatttaataagttcaagaaaaaagggaatctttatacttcagataaagctgttcttgaacattttttttagtcattatcttag

SEQ ID NO: 211 - DNA, 550 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatattttattgcgtgtttggaatcccatttgagaaataagaaatcacgtttaaaatgtgaaagttataactattaacttttgactaaacttgaaaaaactcacatttttgatgtggaaccaaatctgatttgagaaccaagttgattttgatggattttgcaggagaattagccacagaactcacca

SEQ ID NO: 212 - DNA, 746 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaacagacagtggccatggaagcttttcagacagcccttttctaaatagcctggtgggacacatcttgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttcgtcattatcttagttaacc

SEQ ID NO: 213 - DNA, 728 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgacatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatattttattgcgtgtttggaatcccatttgagaataagaaatcacgtttaaatgtgaaagttataactattaacttttgactaaacttgaaaaatcacatttttgatgtggaaccaaatctgatttgagaaccaagttgatttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaagggaatctttatacttcagataaagctgttcttgaacatttttttgtcattatcttagttaaccgag

SEQ ID NO: 214 - DNA, 712 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattggtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatattttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttattaataagttcaagaaaaaggaatcttatacttcagataaagctgttcttgaacattttttt

SEQ ID NO: 215 - DNA, 737 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaatggccatggaagcttttcagacagaccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaaatcatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaaggaatctttatacttcagataaagctgttcttgaacattttttttgtcattatcttagttaaccg

SEQ ID NO: 216 - DNA, 734 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgattttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttattaataagttcaagaaaaaggaatctttatacttcagataaagctgtcttgaacatttttttgtcattatcttagttaaccgag

SEQ ID NO: 217 - DNA, 738 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaaattgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttattaataagttcaagaaaaaggaatctttatacttcagataaagctgttcttgaacattttttttagtcattatcttagtttaaccgag

SEQ ID NO: 218 - DNA, 723 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacatcatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatattttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaaggaatctttatacttcagataaagctgttcttgaacatttttttgtcattatcttagttaaccgag

SEQ ID NO: 219 - DNA, 727 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgagccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatattttattgcgtgtttggaatcccatttgagaataagaaatcacgtttaaaattgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacattttttttagtcattatcttag

SEQ ID NO: 220 - DNA, 737 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaatggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttattaataagttcaagaaaaaggaatctttatacttcagataaagctgattcttgaacatttttttgtcattatcttagttaaccgag

SEQ ID NO: 221 - DNA, 736 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgagccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatattttattgcgtgtttggaatcccatttgagaaataagaaatcacgtttaaaattgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttattaataagttcaagaaaaagggaatctttatacttcagataaagctgttcttgaacatttttttagtcattatcttagttaaccgag

SEQ ID NO: 222 - DNA, 716 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaagggaatctttatacttcagataaagctgttcttgaacattttttt

SEQ ID NO: 223 - DNA, 656 bp, Artificial
  Glycine max FAD3A mutation created with TALEN pair GmFAD3_T01.1
  misc_feature (158): n is a or c or t or g
cactgctttgttatgcctacctcatttcatttggctttagacaacttaaatttgagatctttattatgttctttgcttatatggaagcttttcagacagcccttttctaaatagcctggtgggacacatcttgcattcctcaattcttgtgccatacncatggatggttagttcatcccggcttttttgtttgtcattggaagttcttttattgattcaatttttatagcgtgttcggaaacgcgtttcagaaataatgaaatacatcttgaatctgaaagttataacttttagcttcattgtcattgaaaagttcttttattaattatatttttattgcgtgtttggaatcccatttgagaaataagaaatcacgtttaaatgtgaagttataactattaactttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttattatttaataagttcaagaaaaaggaatctttatacttcagataaagctgtt

SEQ ID NO: 224 - DNA, 652 bp, Artificial
  Glycine max FAD3A mutation created with TALEN pair GmFAD3_T01.1
cactgctttgttatgcctacctcattccatggaagcttttcagacagcccttttctaatagcctggtgggacagcatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaattcacatttttgatgtggaaccaaatctgatttgagaaccaagttgattttgatggattttgcaggagaattagccacagaactcaccatcaaaaatcatggacacattgagaaggatgaatcctgggttccagtatgtgattaactacttcctctatagtttatttttgattcaattaaatttatttatttaataagttcaagaaaaaaggaattctttatacttcagataaagctgttcttgaacattttttttagtcattatcttagttaaccgag

SEQ ID NO: 225 - DNA, 557 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaccatgggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaactgcgtttcagaaaataatgaaatacatcttgaatctgaaagttatacttttagcttcattgtcattgaaaagtttctttttattaattatattttatttgcgtgttcggaattcccatttgagaaataagaaatcacgtttaaaatgtgaaagttataactattaacttttgactaaacttgaaaaaactcacatttttgatgtggaaccaaatctgatttgagaaccaagttgattttgatggattttgcaggagaattagccacagactcaccatc

SEQ ID NO: 226 - DNA, 714 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacataacaggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttattaataagttcaagaaaaagggaatctttatacttcagataaagctgttcttgaacattttttttagtc

SEQ ID NO: 227 - DNA, 714 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttattaataagttcaagaaaaaggaatctttatacttcagataaagctgttcttgaaaatttttttt

SEQ ID NO: 228 - DNA, 660 bp, Artificial
  Glycine max FAD3A mutation created with TALEN pair GmFAD3_T01.1
cactgctttgttatgcctacctcatttcatttggctttagacaacttaaatttgagatctttattatgttctttgcttatatggaagcttttcagacagcccttttctaaatagcctggtgggacacatcttgcattcctcaattcttgtgccatacgacatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaagttataactattaacttttgactaaacttgaaaaaatcacattttgatgtggaaccaaatctgatttgagaaccaagttgattttgatggattttgcaggagaattagccacagaactcaccatcaaaaatcatggacacattgagaaggatgaatcctgggttccagtatgtgattaactacttcctctatagttattttgattcaattaaatttatttatttaataagttcaagaaaaaggaatctttatacttcagataaagctgtt

SEQ ID NO: 229 - DNA, 549 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaacaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaggaatctttatacttcagat

SEQ ID NO: 230 - DNA, 623 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaatgccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgttgactgatcccatttgagaaataagaaatcacgtttaaatgtgaagttataactataacttttgactaaacttgaaaaaactcacatttttgatgtggaaccaaatctgatttgagaaccaagtgattttgatggattttgcaggagaattagccacagaactcaccatcaaaatcaggacacattgagaaggatgaatcctgggttccagtatgtgattaactacttcctctatagttatttt

SEQ ID NO: 231 - DNA, 725 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaaggaatcttatacttcagataaagctgttcttgaacatttttttgtcattatcttag

SEQ ID NO: 232 - DNA, 618 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgagaggttgatgtgcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaaatgtgaaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaatgg

SEQ ID NO: 233 - DNA, 709 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgagccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatattttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttattaataagttcaagaaaaaggaatcttatacttcagataaagctgttcttgaacattttttt

SEQ ID NO: 234 - DNA, 735 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgacatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttattaataagttcaagaaaaaggaatctttatacttcagataaagctgttcttgaacatttttttgtcattatcttagttaaccgagaag

SEQ ID NO: 235 - DNA, 708 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttattaataagttcaagaaaaaggaatcttatacttcagataaagctgttcttgaacattttttt

SEQ ID NO: 236 - DNA, 696 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgactggtgggacacatcttgcattcctcaattcttgtgccataccatggatggttagttcatcccggcttttttgtttgtcattggaagttcttttattgattcaatttttatagcgtgttcggaaacgcgtttcagaaataatgaaatacatcttgaatctgaaagttataacttttagcttcattgtcattgaaagttcttttattaattatatttttaattgcgtgtttggaatcccatttgagaaatagaaatcacgtttaaatgtgaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttacttgaacattttttttagtcattatcttagttaaccgag

SEQ ID NO: 237 - DNA, 736 bp, Artificial
  Glycine max FAD3A mutation created with TALEN pair GmFAD3_T01.1
  misc_feature (679): n is a or c or t or g
cactgctttgttatgcctacctcatttcatttggctttagacaacttaaatttgagatctttattatgttttttgcttatatggtaaagtgattcattcttcacattgaattgaagccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaaattgtgaaagttataactattaacttttgactaaacttgaaaaaactcacatttttgatgtggaaccaaatctgatttgagaaccaagttgatttgatggattttgcaggagaattagccacagaactcaccatcaaaatcatggacacattgagaaggatgaatcctgggttccagtatgtgattaactacttcctctatagttattttgattcaattaaatttattattaataagttcaagaaaaaggaatcttntacttcagataaagctgttcttgaacatttttttagtcattatcttagttaaccgag

SEQ ID NO: 238 - DNA, 739 bp, Artificial
  Glycine max FAD3A mutation created with TALEN pair GmFAD3_T01.1
  misc_feature (679): n is a or c or t or g
cactgctttgttatgcctacctcatttcatttggctttagacaacttaaatttgagatctttattatgttttttgcttatatggtaaagtgattcattcttcacattgaattgagccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatattttattgcgtgtttggaatcccatttgagaaataagaaatcacgtttaaaattgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttattaataagttcaagaaaaaggaatcttntacttcagataaagctgttcttgaacatttttttagtcattatcttagttaaccgagaag

SEQ ID NO: 239 - DNA, 737 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgattttgagaaccaagttgattttgatggattttgcaggagaattagccacagaactcaccatcaaaatcatggacacattgagaaaggatgaatcctgggttccagtatgtgattaactacttcctctatagttattttgattcaattaaatttatttatttaataagttcaagaaaaaaggaatctttatacttcagataaagctgattcttgaacatttttttgtcattatcttagttaaccgag

SEQ ID NO: 240 - DNA, 725 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaatcatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatattttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttattattaataagttcaagaaaaaggaatcttatacttcagataaagctgtcttgaacatttttttagtgattatcttagttaaccgag

SEQ ID NO: 241 - DNA, 713 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaagggaatctttatacttcagataaagctgttcttgaacattttttt

SEQ ID NO: 242 - DNA, 728 bp, Artificial
  Glycine max FAD3A mutation created with TALEN pair GmFAD3_T01.1
  misc_feature (670): n is a or c or t or g
cactgctttgttatgcctacctcatttcatttggctttagacaacttaaatttgagatctttattatgttttttgcttatatggtaaagtgattcattcttcacattgaattgaacaggaagcttttcagacagcccttttctaaatagcctggtgggacacatcttgcattcctcaattcttgtgccataccatggatggttagttcatcccggcttttttgtttgtcattggaagttcttttattgattcaattttatagcgtgttcggaaacgcgtttcagaaaataatgaaatacatcttgaatctgaaagttataacttttagcttcattgtcattgaaagttctttttattaattatatttttattgcgtgtttggaatcccatttgagaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggattgaatcctgggttccagtatgtgattaactacttcctctatagttattttgattcaattaaatttattattaatagttcaagaaaaggaatcttntactcagataaagctgttcttgaacatttttttgtcattatcttagttaaccgagaag

SEQ ID NO: 243 - DNA, 717 bp, Artificial
  Glycine max FAD3A mutation created with TALEN pair GmFAD3_T01.1
  misc_feature (646): n is a or c or t or g
cactgctttgttatgcctacctcatttcatttggctttagacaacttaaatttgagatctttattatgttttttgcttatatggtaaagtgattcattcttcacattgaattgaccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttnttaataagttcaagaaaaaaggaatctttatactcagataaagctgtcttgaacatttttttgtcattatc

SEQ ID NO: 244 - DNA, 659 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgactggtgggacacatcttgcattcctcaattcttgtgccataccatggatggttagttcatcccggcttttttgtttgtcattggaagttcttttattgattcaatttttatagcgtgttcggaaacgcgtttcagaaataatgaaatacatcttgaatctgaaagttataacttttagcttcattgtcattgaaagttcttttattaattatatttttattgcgtgtttggaatcccatttgagaaataagaaatcacgtttaaaatgtgaagttataactattaacttttgactaaacttgaaaaaatcacattttgatgtggaaccaaatctgatttgagaaccaagttgattttgatggattttgcaggagaattagccacagaactcaccatcaaaaatcatggacacattgagaaggatgaatcctgggttccagtatgtgattaactacttcctctatagttatttttgattcaattaaaatttatttatttaataagttcaagaaaaaaggaatctttatacttcagataaagctgtt

SEQ ID NO: 245 - DNA, 713 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccaaagaactcaccatcaaaatcatggacacattgagaaggatgaatcctgggttccagtatgtgattaactacttcctctatagttattttgattcaattaaatttatttattaataagttcaagaaaaaggaatcttatacttcagataaagctgttcttgaacattttttt

SEQ ID NO: 246 - DNA, 743 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaacagacagtggccatggaagcttttcagacagcccttttctaaatagcctggtgggacacatcttgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttgtcattatctagttaacc

SEQ ID NO: 247 - DNA, 580 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaatatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatattttattgcgtgtttggaatcccatttgagaaattaagaaaattcatcgtttaaaaattgtgaaagttataactattaacttttgactaaacttgaaaaaatcacattttgatgtggaaccaaatctgattttgagaaccaagttgaattttgatggattttgcatggagaattagccacagaactcaccattcaaaatcatggactacattgagaagga

SEQ ID NO: 248 - DNA, 738 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaagccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaaggaatctttatacttcagataaagctgattcttgaacatttttttgtcattatcttagttaaccgag

SEQ ID NO: 249 - DNA, 598 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaacaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaaggaatctttatacttcagataaaagctgttcttgaacattttttttgtcattatcttagttaaccgag

SEQ ID NO: 250 - DNA, 711 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgacatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaattgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttattaataagttcaagaaaaagggaatcttatacttcagataaagctgttcttgaacattttttt

SEQ ID NO: 251 - DNA, 732 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatattttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgatttgatggattttgcaggagaattagccacagactcaccatcaaaatcatggacacattgagaaggatgaatcctgggttccagtatgtgattaactacttcctctatagttatttttgattcaattaaatttatttattaataagttcaagaaaaaggaatctttatacttcagataaagctgttcttgaacatttttttagtcattatcttagttaaccgag

SEQ ID NO: 252 - DNA, 697 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaagggaatctttatacttcagataaagctg

SEQ ID NO: 253 - DNA, 732 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttattattatagttcagaaaaaggaatctttatacttcagataaagctgttcttgaacattttttttagtcattatcttagtttaaccgag

SEQ ID NO: 254 - DNA, 728 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatattttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaagggaatctttatacttcagataaagctgttcttgaacattttttgtcattatcttagttaaccgag

SEQ ID NO: 255 - DNA, 625 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgcatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatattttattgcgtgtttggaatcccatttgagaataagaaatcacgtttaaaatgtgaaagttataactattaacttttgactaaacttgaaaaaactcacatttttgatgtggaaccaaatctgattttgagaaccaagttgattttgatggattttgcaggagaattagccacagaactcaccatcaaaatcatggacacattgagaaggatgaatcctgggttccagtatgtgattaactacttcctctatagttatttt

SEQ ID NO: 256 - DNA, 768 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaatgtccagcgcctgcttgccaccgccattgctggcgatggccaccacctgctggggggtcaagccgtgggcctggccatggaagcttttcagacagccctttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaattcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatgggacacattgagaaggatgaatcctgggttccagtatgtgattaactacttcctctatagttatttttgattcaattaaatttatttatttataagtcaagaaaaagggaatctttatacttcagataaagctgttc

SEQ ID NO: 257 - DNA, 709 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaatggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatattttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaggaatctttatacttcagataaagctgttcttgaacattttttt

SEQ ID NO: 258 - DNA, 713 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaatggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttattattaataagttcaagaaaaaggaatcttatacttcagataaagctgttcttgaacatttttttt

SEQ ID NO: 259 - DNA, 603 bp, Artificial
  Glycine max FAD3A mutation created with TALEN pair GmFAD3_T01.1
  misc_feature (533): n is a or c or t or g
cactgctttgttatgcctacctcatttcatttggctttagacaacttaaatttgagatctttattatgttttttgcttatatggtaaagtgattcattcttcacattgaattcagtggccatggaagcttttcagacagcccttttctaaatagcctggtgggacacatcttgcattcctcaattcttgtgccataccatggatggttagttcatcccggcttttttgttgtcattggaagttctttttattgaattcaatttttatagcgtgttcggaaacgcgtttcagaaaataatgaaaatacatctgaatctgaaaagttataacttttagcttcattgtcattgaaagttcttttattaattatattttttattgcgtgtttggaatcccatttgagaaataagaaatcacgtttaaaatgtgaaagttataactattaacttttgactaaacttgaaaaaatcacattttgatgtggaaccaaatctgatttgagaaccaaagttgattttgatggatttgcaggnaattagccacagaactcaccatcaaaatcatggacacattgagaaggatgaatcctgggttccagtatgg

SEQ ID NO: 260 - DNA, 622 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgattttgagaaccaagttgattttgatggattttgcaggagaattagccacagaactcaccatcaaaatcatggacacattgagaaggatgaatcctgggttccagtatgtgattaactacttcctctatag

SEQ ID NO: 261 - DNA, 710 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcgccatcaaaatcatggacacattgagaaggatgaatcctgggttccagtatgtgattaactacttcctctatagttattttgattcaattaaatttatttattaataagttcaagaaaaaggaatcttatacttcagataaagctgttcttgaacattttttt

SEQ ID NO: 262 - DNA, 727 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaatatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatattttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaaggaatctttatacttcagataaagctgttcttgaacatttttttgtcattatcttagttaaccgag

SEQ ID NO: 263 - DNA, 588 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaacaatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcccgg

SEQ ID NO: 264 - DNA, 729 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaatccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatattttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggagaatcctgggttccagtatgtgattaactacttcctctatagttattttgattcaattaaatttatttatttaataagttcaagaaaaaaggaatctttatacttcagataaagctgttcttgaacatttttttgtcattatcttagttaaccgag

SEQ ID NO: 265 - DNA, 503 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgacatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagtt

SEQ ID NO: 266 - DNA, 805 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcaccattattgctggcgatggccaccggggtgcctaatgagtgagctaactcacattaattgcgttgcgctcactgcccgctggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaactttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaaggaatctttatacttcagataaagctgttcttgaacattttttttgtcattattctagtttaaccga

SEQ ID NO: 267 - DNA, 676 bp, Artificial
  Glycine max FAD3A mutation created with TALEN pair GmFAD3_T01.1
cactgctttgttatgcctacctcatttcatttggctttagacaacttaaatttgagatctttattcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgattgagaaccaagttgattttgatggattttgcaggagaatttagccacatgaactcaccatcaaaatcatggacacattgagaaggatgaatcctgggttccagtatgtgattaactacttcctctatagttatttttgattcaattaaatttatttatttaataagttcaagaaaaaatggaatctttatacttcagataaagctgtcttgaacattttttttgtcattatctagtttaaccgagaag

SEQ ID NO: 268 - DNA, 694 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttcttttattaattatatttttattgcgtgtttggaatcccatttgagaaataagaaatcacgtttaaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaaaggaatcttatacttcagataaagc

SEQ ID NO: 269 - DNA, 713 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaacatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttatttgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttattaataagttcaagaaaaaggaatctttatacttcagataaagctgttcttgaacatttttttt

SEQ ID NO: 270 - DNA, 629 bp, Artificial
  Glycine max FAD3A mutation created with TALEN pair GmFAD3_T01.1
cactgctttgttatgcctacctcatttcatttggctttagacaacttaaatttgagatctttattatgtttttttgcttatatggtaaagtgattcattcttcacattgaattggccatggaagcttttcagacagcccttttctaaatagccggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaaattatatttttattgcgtgtttggaatcccatttgagaaattaagaaatcacgtttaaaaattgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagtta

SEQ ID NO: 271 - DNA, 784 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgacgtaaggtcatcgattacccatacgatgttccagattacgctatcgattggccatggaagcttttcagacagccctttttctaaatagcctggtgggacacatcttgcattcctcaattcttgtgccataccatggatggttagttcatcccggctttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggatttgcaggagtaattagccacagaactcaccatcaaatcatggacacattgagaaggatgaatcctgggttccagtatgtgattaactacttcctctatagttatttttgattcaattaaatttatttatttataagttcaagaaaaaggaatctttatacttcagataaagcatgttctttgaacattttttttgtcattattctagtttaaccga

SEQ ID NO: 272 - DNA, 679 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgattttgacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttcttttattaattatatttttattgcgtgtttggaatcccatttgagaaaataagaaatcactgattaaatgtagaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttattatttaaataagttcaagaaaaaaggaatctttatacttcagataaagctg

SEQ ID NO: 273 - DNA, 653 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaattgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatt

SEQ ID NO: 274 - DNA, 708 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacatcatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaattgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttggattcaattaaatttatttatttaataagttcaagaaaaaagggaatctttatacttcagataaagctgttcttgaacatttttttt

SEQ ID NO: 275 - DNA, 724 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacatcatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatattttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaaggaatcttatacttcagataaagctgttcttgaacatttttttgtcattatcttagttaaccgag

SEQ ID NO: 276 - DNA, 548 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaacatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatattttcattgcgtgtttggaatcccatttgagaaataagaaatcacgtttaaattgtgaaagttataactattaacttttgactaaacttgaaaaactcacattttgatgtggaaccaaatctgatttgagaacaagttgatttgatggattttgcaggagaattagccacagaactcaccatcaaaa

SEQ ID NO: 277 - DNA, 733 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattcatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcattaaatttatttatttaataagttcaagaaaaaagggaatctttatacttcagataaagctgttcttgaacatttttttagtcattatcttagttaaccgag

SEQ ID NO: 278 - DNA, 722 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaacaggcccacggcttgaccccggagcaggtggtggccatcgccagccacgatggcggcaagcaggcgctggagacggtccagcggctatggccatggaagcttttcagacagcccttttctaaatagcctggtgggacacatcttgcattcctcaattcttgtgccataccatggatggttagttcatcccggcttttttgtttgtcattggaagttctttttattgattcaatttttatagcgtgttcggaaaacgcgtttcagaaaataatgaaatacatcttgaatctgaaagttataacttttagcttcattgtcattgaaagttcttttattaattatattttattgcgtgtttggaatccattgagaaataagaaatcacgtttaaaatgtgaaagttataactattaacttttgactaaacttgaaaaaaatcacattttgatgtggaaccaaatctgatttgagaaccaagttgattttgatggattttgcatggagaattagccacagaactcaccatcaaaatcatggacacattgagaaggatgaatcctgggttccagtatgtgattaactacttcctctatagttatttttgatt

SEQ ID NO: 279 - DNA, 728 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaacccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaattgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttattaataagttcaagaaaaaggaatctttatacttcagataaagctgttcttgaacatttttttagtcattatcttag

SEQ ID NO: 280 - DNA, 719 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacatggaagcttttcagacagcccttttctaaatagcctggtgggacacatctgcattcctcaattcttgtgccataccatgggtggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatattttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttattaataagttcaagaaaaaggaatctttatacttcagataaagctgttcttgaacatttttttgtcattatcttagttaaccgag

SEQ ID NO: 281 - DNA, 551 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaataatgaaatacatcttgaatctgaaagttataacttttagcttcattgtcattgaaaagttctttttattaattatattttattgcgtgtttggaatcccatttgagaaattaagaaatcacgttttaaaatgtgaaagttataactattaacttttgactaaacttgaaaaaatcacattttgatgtggaaccaaattctgatttgagaaccaagttgaatttgatggattttgcatggagaattagccacagaactcaca

SEQ ID NO: 282 - DNA, 733 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttattattaataagttcaagaaaaaggaatcttatacttcagataaagctgttcttgaacattttttttgtcattatcttagttaaccgag

SEQ ID NO: 283 - DNA, 738 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataactttttagcttcattgtcattgaaagttctttttattaattatatttttattgcgtgtttggaatcccatttgagaaataagaaatcacgtttaaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttattattaataagttcaagaaaaaggaatctttatacttcagataaagctgttcttgaacattttttttgtcattatcttagttaaccgag

SEQ ID NO: 284 - DNA, 742 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaagggaatctttatacttcagataaagctgttcttgaacatttttttgtcattatcttagttaaccgagaag

SEQ ID NO: 285 - DNA, 585 bp, Artificial
  Glycine max FAD3A mutation created with TALEN pair GmFAD3_T01.1
cactgctttgttatgcctacctcatttcatttggctttagacaacttaaatttgagaatctttattatgttttttgcttatatggtaaagtgattcattcttcacattgaattgaatggaagcttttcagacagcccttttctaaatagcctggtgggacacatcttgcattcctcaattcttgtgccataccatggatggttagttcatcccggcttttttgtttgtcattggaagttcttttattgattcaattttatagcgtgttcggaaacgcgtttcagaaaataatgaaatacatcttgaatctgaaagttataacttttagcttcattgtcattgaaagttcttttattaattatattttattgcgtgtttggaatcccatttgagaaataagaaatcacgtttaaaattgtgaaagttataactattaacttttgactaaacttgaaaaaactcacatttttgatgtggaaccaaatctgatttgagaaccaagttgatttgatggattttgcaggagaattagccacagaactcaccatcaaaatcatggacacattgagaaggatgaatcctggg

SEQ ID NO: 286 - DNA, 635 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattggtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaattgtgaaagttataactattaacttttgactaaacttgaaaaaatcacatttttgatgtggaaccaaatctgattttgagaaccaagttgaattttgatggattttgcaggagaattagccacagaactcaccatcaaaatcatggacacattgagaaggatgaatcctgggttccagtatgtgattaactacttcctctatagttattttg

SEQ ID NO: 287 - DNA, 740 bp, Artificial
  Glycine max FAD3A mutation created with TALEN pair GmFAD3_T01.1
  misc_feature (695): n is a or c or t or g
cactgctttgttatgcctacctcatttcatttggctttagacaacttaaatttgagatctttattatgttttttgcttatatggtaaagtgattcattcttcacattgaatcagtccatggaagcttttcagacagcccttttctaaatagcctggtgggacacatcttgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaattttattttattttaataaagttcaagaaaaatggaatctttatacttcaganaaagctgttcttgaacattttttttcgtcattatcttagttaacc

SEQ ID NO: 288 - DNA, 571 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaacggaaacgcgtttcagaaaataatgaaatacatcttgaatctgaaagttataacttttagcttcattgtcattgaaagttcttttattaattatatttttattgcgtgtttgggaatcccatttgagaaataagaaatcacgtttaaaatgtgaaagttataactattaacttttgactaaacttgaaaaaatcacatttttgatgtggaaccaaaatctgatttgagaaccaagttgatttttgatggattttgcaggagaattagccacagaactcaccatcaaaaatcatggacacattgagaaggatgaaatcctgggttccagtatgtgattaactacttcctctatagttatttttgattcaattaaattttatttatttaataagttcaagaaaaaaggaatcttatacttcagataagctgttcttgaacattttttttgtcattatc

SEQ ID NO: 289 - DNA, 715 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaagggaatctttatacttcagataaagctgttcttgaacattttttt

SEQ ID NO: 290 - DNA, 689 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttcttttattaattatattttattgcgtgtttggaatcccatttgagaaataagaaatcacgtttaaaaatgtgaaagttataactattaacttttgactaaacttgaaaaaactcacatttttgatgtggaaccaaatctgatttgagaaccaagttgatttgatggattttgcaggagaattagccacagaactcaccatcaaaatcatggacacattgagaaggatgaatcctgggttccagtatgtgattaactacttcctctatagttatttttgattcaattaaatttatttattaataagttcaagaaaaaaggaatctttatacttcagataaagc

SEQ ID NO: 291 - DNA, 735 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgagtccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataactttttagcttcattgtcattgaaaagttctttttattaattatatttttattgcgtgtttggaatcccatttgtagaaataaagaaatacacgtttaaaaattgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaggaatctttatacttcagataaagctgttcttgaacattttttttagtcattatcttag

SEQ ID NO: 292 - DNA, 576 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaacaatttttatagcgtgttcggaaacgcgtttcagaaaataatgaaatacatcttgaatctgaaagttataacttttagcttcattgtcattgaaagttcttttattaattatatttttattgcgtgttttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaaatcatggacacattgagaaggatgaatcctgggttccagtatgtgattaactacttcctctatagttatttttgattcaattaattatttatttaataagttcaagaaaaaggaatctttatacttcagataaaagctgttcttgaacatttttttt

SEQ ID NO: 293 - DNA, 756 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaatttccagcgcctgcttgccaccaatattgctggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggatttgcaggagaattagccacagaactcaccatcaaaatcatggacacattgagaaggatgaatcctgggttccagtatgtgattaactacttcctctatagttatttttgattcaattaaatttattttatttaataagtttcaagaaaaatggaatctttatacttcagataaagctgttcttgaacattttttttcgtcattatct

SEQ ID NO: 294 - DNA, 697 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtcaagccgtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaataatgaaatacatcttgaatctgaaagttataacttttagcttcattgtcattgaaaagttcttttattaattatatttttaattgcgtgtttggaatcccatttgagaaataagaaatcacgtttaaaatgtgaagttataactattaacttttgactaaacttgaaaaaatcacatttttgatgtggaaccaaatctgatttgagaaccaagttgattttgatggattttgcaggagaattagccacagaactcaccatcaaaaatcatggacacattgagaaggatgaatcctgggttccagtatgtgattaactacttcctctatagttatttttgattcaattaaaatttatttatttaataagttcaagaaaaaagggaatctttatacttcagataaagctgttcttgaacatttttttt

SEQ ID NO: 295 - DNA, 551 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgcccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatt

SEQ ID NO: 296 - DNA, 706 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgagcttttcagacagcccttttctaaatagcctggtgggacacatcttgcattcctcaattcttgtgccataccatggatggttagttcatcccggcttttttgtttgtcattggaagttcttttattgattcaattttatagcgtgttcggaaacgcgtttcagaaaataatgaaatacatcttgaatctgaaagttataacttttagcttcattgtcattgaaagttcttttattaattatattttattgcgtgtttggaatcccatttgagaaataagaaatcacgtttaaaaattgtgaaagttataactattaacttttgactaaacttgaaaaaactcacatttttgatgtggaaccaaatctgattttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaagggaatctttatacttcagataaagctgttcttgaacattttttt

SEQ ID NO: 297 - DNA, 668 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaaattgtgaaagttataactattaacttttgactaaacttgaaaaaactcacatttttgatgtggaaccaaatctgatttgagaaccaagttgatttgatggattttgcaggagaattagccacagaactcaccatcaaaatcatggacacattgagaaggattgaatcctgggttccagtatgtgattaactacttcctcctatagttattttggtattcaattaaatttatttatttaataagtc

SEQ ID NO: 298 - DNA, 737 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgacaggaagctttttcagacagcccttttctaaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttattaataagttcaagaaaaaagggaatctttatacttcagataaagctgttcttgaacattttttttagtcattatcttagttaaccgag

SEQ ID NO: 299 - DNA, 730 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaacatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttattaataagttcaagaaaaaggaatcttatacttcagataaagctgttcttgaacatttttttgtcattatcttagttaaccga

SEQ ID NO: 300 - DNA, 645 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaattta

SEQ ID NO: 301 - DNA, 551 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaacaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaaatcatggacacattgagaaggatgaatcctgggttccagtatgtgattaactacttcctctatagttattttgattcaattaaatttatttatttaataagttcaagaaaaaaggaatctttatacttcagat

SEQ ID NO: 302 - DNA, 718 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattggtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgattttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaaggaatctttatacttcagataaagctgttcttgaacattttttt

SEQ ID NO: 303 - DNA, 644 bp, Artificial
  Glycine max FAD3A mutation created with TALEN pair GmFAD3_T01.1
cactgctttgttatgcctacctcatttcatttggctttagacaacttaaatttgagatctttattatgttttcaggctattttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaatggaatctttatacttcagat

SEQ ID NO: 304 - DNA, 571 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgagagactggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaaataagaaatcacgtttaaaatgtgaagttataactattaactttgactaaacttgaaaaaatcacattttgatgtggaaccaaatctgatttgagaaccaagttgattttgatggattttgcaggagaattagccacagaactcaccatcaaaaatcatggcacattgagaaggatgaatcctgggttccagtatgtgattaact

SEQ ID NO: 305 - DNA, 730 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaatccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaagggaatctttatacttcagataaagctgttcttgaacatttttttgtcattatcttagttaaccgag

SEQ ID NO: 306 - DNA, 734 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttattaataagttcaagaaaaaggaatctttatacttcagataaagctgttcttgaacatttttttgtcattatcttagttaaccgag

SEQ ID NO: 307 - DNA, 700 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaagaagggtacacatcttgcattcctcaattcttgtgccataccatggatggttagttcatcccggcttttttgtttgtcattggaagttcttttattgattcaattttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaaatcatggacacattgagaaggatgaatcctgggttccagtatgtgattaactacttcctctatagttatttttgattcaattaaatttatttatttaataagttcaagaaaaaaggaatctttatacttcagataaagctgttcttgaacattttttttgtcattatcttagttaaccgag

SEQ ID NO: 308 - DNA, 625 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagtta

SEQ ID NO: 309 - DNA, 730 bp, Artificial
  Glycine max FAD3A mutation created with TALEN pair GmFAD3_T01.1
cactgctttgttatgcctacctcatttcatttggctttagacaacttaaatttgagatctttattatgttttttgcttaaataaataaagtgattcattcttcacattgccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatattttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaagggaatctttatacttcagataaagctgttcttgaacatttttttagtcattatcttagttaaccgag

SEQ ID NO: 310 - DNA, 764 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaatgctggggggtcaagccgtgggcctggcacagcaccggcaacagccgctggaccgtctccagcggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgaattttgatggattttgcaggagaattagccacagaactcaccatcaaaatcatggacacattgagaaggatgaatcctgggtttccagtatgtgattaactacttcctctatagttatttttgattcaattaaatttatttatttaataagttcaagaaaaaagggaatctttatacttcagataaagctg

SEQ ID NO: 311 - DNA, 738 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgatggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataaacttttagcttcattgtcattgaaaagttctttttattaattatatttttattgcgtgtttggaatcccatttgagaataagaaatcacgttttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaggaatctttatacttcagataaagctgttcttgaacatttttttgtcattatcttagttaaccgag

SEQ ID NO: 312 - DNA, 553 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaacaatttttatagcgtgttcggaaacgcgtttcagaaaataatgaaatacatcttgaatctgaaagttataacttttagcttcattgtcattgaaagttcttttattaattatattttttattgcgtgttttggaatcccatttgagaaataagaaatcacgtttaaaatgtgaaagttataactattaacttttgactaaacttgaaaaaatcacatttttgatgtggaaccaaatctgatttgagaaccaagttgatttttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaaggaatctttatacttcagat

SEQ ID NO: 313 - DNA, 712 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttattaataagttcaagaaaaaggaatcttatacttcagataaagctgttcttgaacattttttt

SEQ ID NO: 314 - DNA, 725 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttatttaaattatatttttattgcgtgtttggaatcccatttgagaaataagaaatcacgtttaaaattgtgaaagttataactattaacttttgactaaacttgaaaaaactcacatttttgatgtggaaccaaatctgatttgagaaccaagttgattttgatggattttgcaggagaattagccacagactcaccatcaaaatcatggacacattgagaaggatgaatcctgggttccagtatgtgattaactacttcctctatagttattttgattcattaaatttatttattaataagttcaagaaaaggatcttatacttcagataaagctgttcttgaacattttttttagtcattatcttag

SEQ ID NO: 315 - DNA, 646 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatattttattgcgtgtttggaatcccatttgagaaataagaaatcacgtttaaaaattgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttattta

SEQ ID NO: 316 - DNA, 654 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaacagcttgaccccccagcaggtggtggccatcgccagcaatggcggtggcaagcaggcgctggagacggtccagcggctgttgccggtgctgtgccaggcccacggcttgaccccggagcaggcgaagcaggcgctggagacggtccagcggctgttgccggtgctgtgccaggcccacggcttgaccccggagcaggtggtggccagtggccatggaagcttttcagacagcccttttctaaaatagcctggtgggacacatcttgcattcctcaattcttgtgccataccatggatggttagttcatcccggctttttgtttgtcattggaagttcttttattgattcaatttttatagcgtgttcggaaacgcgttcagaaaataatgaatacatcttgaatctgaaagttataacttttagcttcattgtcattgaaagttcttttattaattatatttttattgcgtgtttggaatccatttgagaaataagaatcacgtttaaaatgtgaaagttataactattaactttgact

SEQ ID NO: 317 - DNA, 820 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaacaatggccaccacctgctggggggtcaagccgtgggcctggcacagcaccggcaacagccgctggaccgtctccagcgcctgcttgccgccatttggccatggaagcttttcagacagcccttttctaaatagcctggtgggacacatcttgcattcctcaattcttgtgccataccatggatggttagttcatcccggctttttgtttgtcatggaagttcttttattgattcaatttttatagcgtgttcggaaaacgcgtttcagaaaataatgaaatacatcttgaatctgaaagttataacttttagcttcattgtcattgaaagttcttttattaattatatttttattgcgtgtttggaatcccattgagaaataagaaatcacgtttaaatgtgaaagttataactattaactttgactaaacttgaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacatttttttgtcattatcttagttaa

SEQ ID NO: 318 - DNA, 701 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatattttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttattattaataagttcaagaaaaaaggaatctttatacttcagataaagctgttcttgaacattttttt

SEQ ID NO: 319 - DNA, 739 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaatgtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcatttgtcattgaaagttctttttattaattatatttttatttgcgtgtttggaatcccatttgagaaattaagaaatcacgtttaaaaatgtgaaagttataactattaacttttgactaaaacttgaaaaaatcacatttttgatgtggaaccaaatctgatttgagaaccaagttgattttgatggattttgcaggagaattagccacagaactcaccatcaaaaatcatggacacattgagaagggatgaatcctgggttccagtatgtgattaactacttcctctatagttatttttgattcaattaaaatttatttatttaataagttcaagaaaaaaagggaatctttatacttcagataaagctgattcttgaacattttttttgtcattatcttag

SEQ ID NO: 320 - DNA, 734 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatattttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaggaatctttatacttcagataaagctgttcttgaacattttttttgtcattatcttagttaaccgag

SEQ ID NO: 321 - DNA, 626 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaatcatggaagctttttcagacaaccttcctttcaataaagctgtggcagtgacatctctgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaaattgtgaaagttataactattaacttttgacttaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagtta

SEQ ID NO: 322 - DNA, 713 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgacatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaagggaatctttatacttcagataaagctgttcttgaacatttttttt

SEQ ID NO: 323 - DNA, 708 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttcttttattaattatattttattgcgtgtttggaatcccatttgagaaataagaaatcacgtttaaaattgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttattattaataagttcaagaaaaaggaatctttatacttcagataaagctgttcttgaacattttttt

SEQ ID NO: 324 - DNA, 659 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaacagacagtggccatggaagcttttcagacagcccttttctaaatagcctggtgggacacatcttgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttattta

SEQ ID NO: 325 - DNA, 706 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttcttttattaattatattttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttattaataagttcaagaaaaaaggaatctttatacttcagataaagctgttcttgaacattttttt

SEQ ID NO: 326 - DNA, 732 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgatggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataactttttagcttcattgtcattgaaagttctttttattaattatatttttattgcgtgtttggaatcccatttgagaaataagaaatcacgtttaaaattgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaggaatcttatacttcagataaagctgttcttgaacatttttttgtcattatcttaattaa

SEQ ID NO: 327 - DNA, 663 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaatgtgaagttataactattaacttttgactaaacttgaaaaaatcacattttgatgtggaaccaaatctgatttgagaaccaagttgattttgatggattttgcaggagaattagccacagaactcaccatcaaaaatcatggacacattgagaaggatgaatcctgggttccagtatgtgattaactacttcctctatagttatttttgattcaattaaatttatttatttaataagttcaagaaaaaggaatctttatacttcagataaagctgtt

SEQ ID NO: 328 - DNA, 709 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaacaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatattttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaagggaatctttatacttcagataaagctgttcttgaacattttttt

SEQ ID NO: 329 - DNA, 584 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaacggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaaccaaaatctgatttgagaaccaagttgatttttgatggattttgcaggagaattagccacagaactcaccatcaaaaatcatggacacattgagaaggatgaatcctgggttccagtatgtgattaactacttcctctatagttatttttgattcaattaaatttatttatttaataagttcaagaaaaaaaggaatctttatacttcagataaagctgttcttgaacattttttttgtcattatcttaagttaaccg

SEQ ID NO: 330 - DNA, 683 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatattttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttattatttaataagttcaagaaaaaagggaatctttatacttcagataaagctg

SEQ ID NO: 331 - DNA, 715 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaatggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttattaataagttcaagaaaaaggaatctttatacttcagataaagctgttcttgaacatttttttt

SEQ ID NO: 332 - DNA, 710 bp, Artificial
  Glycine max FAD3A mutation created with TALEN pair GmFAD3_T01.1
cactgctttgttatgcctacctcatttcatttggctttagacaacttaaatttgagatctttattatgttttttgcttaaataaataaagtgattcattcttcacattgccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaaattgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaaggaatctttatacttcagataaagctgttcttgaacatttttttt

SEQ ID NO: 333 - DNA, 733 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttattattaataagttcaagaaaaaggaatctttatacttcagataaagctgttcttgaacatttttttgtcattatcttagttaaccgag

SEQ ID NO: 334 - DNA, 715 bp, Artificial; identical to SEQ ID NO: 331
  Glycine max FAD3A mutation created with TALEN pair GmFAD3_T01.1

SEQ ID NO: 335 - DNA, 613 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaagcttttcagacagcccttttctaaatagcctggtgggacacatctgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatattttattgcgtgtttggaatcccatttgagaaataagaaatcacgtttaaaaatgtgaaagttataactattaacttttgaactaaacttgaaaaaatcacatttttgatgtggaaccaaatctgatttgagaaccaagttgaatttgatggattttgcaggagaattagccacagaactcaccatcaaaatcatggacacattgagaaggatgaatcctgggttccagtatgtgattaactacttcctctatag

SEQ ID NO: 336 - DNA, 711 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatattttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttattattaataagttcaagaaaaaggaatctttatacttcagataaagctgttcttgaacatttttttt

SEQ ID NO: 337 - DNA, 622 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgagccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttctgtcattgaaaagtttctttttatttaattatatttttatttgcggtttggaatcccatttgagaaataagaaatcacgtttaaaatgtgaaagttataactattaacttttgactaaacttgaaaaaactcacatttttgatgtggaaccaaatctgtttgagaaccaagttgattttgatggattttgcaggagaattagccacagaactcaccatcaaaatcatggacacattgagaaggatgaatcctgggttccagtatgtgattaactacttcctctatag

SEQ ID NO: 338 - DNA, 695 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaacacatcttgcattcctcaattcttgtgccataccatggatggttagttcatcccggcttttttgtttgttcattggaagttcttttattgattcaatttttattagcgtgtttcggaaacgcgtttcagaaaataatgaaatacatcttgaatctgaaagttataacttttagcttcattgtcattgaaaagttcttttattaattatatttttattgcgtgtttggaatccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccaatcaaaatcatggacacattgagaaggatgaatcctgggttccagtatgtgattaactacttcctctatagttatttttgattcaattaaatttatttatttaataagttcaagaaaaaaggaatctttatacttcagataaagctgttcttgaacattttttttagtcattatcttagttaaccgag

SEQ ID NO: 339 - DNA, 741 bp, Artificial
  Glycine max FAD3A mutation created with TALEN pair GmFAD3_T01.1
  misc_feature (683): n is a or c or t or g
cactgctttgttatgcctacctcatttcatttggctttagacaacttaaatttgagatctttattatgttttttgcttatatggtaaagtgattcattcttcacattgaattgaacatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaaattgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttattaataagttcaagaaaaaagggaatctttntactcagataaagctgtcttgaacattttttttagtcattatcttagtaaccgagaag

SEQ ID NO: 340 - DNA, 699 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaagcccttttctaaatagcctggtgggacacatcttgcattcctcaattcttgtgccataccatggatggttagttcatcccggctttttgtttgtcattggaagttcttttattgattcaatttttatagcgtgttcggaaacgcgtttcagaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaaatcatggacacattgagaaggatgaatcctgggttccagtatgtgattaactacttcctctatagttatttttgattcaattaaatttatttatttaataagttcaagaaaaaaggaatctttatacttcagataaagctgttcttgaacattttttttgtcatta

SEQ ID NO: 341 - DNA, 729 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaagtggccatggaagcttttcagacagcccttttctaaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaaattgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttattattaataagttcaagaaaaaaggaatcttatacttcagataaagctgttcttgaacattttttttagtcattatcttag

SEQ ID NO: 342 - DNA, 684 bp, Artificial
  Glycine max FAD3A mutation created with TALEN pair GmFAD3_T01.1
cactgctttgttatgcctacctcatttcatttggctttagacaacttaaatttgagatctttcatttggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaatggaatctttatacttcagataaagctgttcttgaacatttttttttcgtcattatcttag

SEQ ID NO: 343 - DNA, 698 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaagggaatctttatacttcagataaagctg

SEQ ID NO: 344 - DNA, 485 bp, Artificial
  Glycine max FAD3A mutation created with TALEN pair GmFAD3_T01.1
cactgctttgttatgcctacctcatttcatttggctttagacaacttaaatttgagatctttattatgtttttgcttatatggtaaagtgattcattttcagacagccctttctaaatagcctggtgggacacatcttgcattcctcaattcttgtgccataccatggatggttagttcatcccggcttttttgtttgtcattggaagttctttattgattcaatttttatagcgtgttcggaaacgcgtttcagaaataatgaaatacatcttgaatctgaaagttataacttttagcttcattgtcattgaaaagttcttttattaattatatttttaattgcgtgtttggaatcccatttgagaaataagaaatcacgtttaaaatgtgaaagttataactattaactttgactaaacttgaaaaaatcacattttgatgtggaaccaaatctgatttgagaaccaagttgattttgatgga

SEQ ID NO: 345 - DNA, 740 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgcccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaattgtgaaagttataactattaacttttgactaaacttgaaaaaactcacattttttggattgtggaaccaaatctgattttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttattaatagttcaagaaaaagggaatctttatacttcagataaagctgttcttgaacattttttttagtcattatcttagttaaccgag

SEQ ID NO: 346 - DNA, 548 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatattttattgcgtgtttggaatcccatttgagaataagaaatcacgtttaaaatgtgaaagttataactattaacttttgactaaacttgaaaaaatcacatttttgatgtggaaccaaatctgatttgagaaccaagttgaattttgatggattttgcatggagaattagccacagaactcacca

SEQ ID NO: 347 - DNA, 724 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacatatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatattttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaagggaatctttatacttcagataaagctgttcttgaacatttttttgtcattatcttagttaaccgag

SEQ ID NO: 348 - DNA, 715 bp, Artificial
  Glycine max FAD3A mutation created with TALEN pair GmFAD3_T01.1
  misc_feature (682): n is a or c or t or g
cactgctttgttatgcctacctcatttcatttggctttagacaacttaaatttgagatctttattatgttttttgcttatatggtaaagtgattcattcttcacattgaattgaaccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccattcaaaatcatggacacattgagaaggattgaatcctgggttccagtatgtgattaactacttcctctatagttattttgattcaattaaaatttatttattaataagttcaagaaaaaagggaatctttntactcagataaagctgtcttgaacatttttttt

SEQ ID NO: 349 - DNA, 681 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattttgcattcctcaattcttgtgccataccatggatggttagttcatcccggctttttttgtttgtcattggaagttcttttattgattcaatttttatagcgtgttcggaaacgcgtttcagaaataatgaaatacatcttgaatctgaaagttataactttttagcttcattgtcattgaaagttcttttattaattatatttttattgcgtgtttggaatcccattttgagaaataagaaatcacgtttaaaatgtgaaaagttataactattaacttttgactaaacttgaaaaaatcacatttttgatgtggaaccaaatctgattgagaaccaagttgattttgatggattttgcaggagaattagccacatgaactcaccatcaaaatcatggacacattgagaaggatgaatcctgggttccagtatgtgattaactacttcctctatagttatttttgattcaattaatttatttatttaataagttcaagaaaaaatggaatctttatacttcagataaagctgtcttgaacattttttttgtcattatctagtttaaccgagaag

SEQ ID NO: 350 - DNA, 748 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaacagacagtggccatggaagcttttcagacagcccttttctaaatagcctggtgggacacatcttgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaatttatttatttaataagttcaagaaaaatggaatctttatacttcagataaagctgttcttgaacattttttttcgtcattatctagttaaccga

SEQ ID NO: 351 - DNA, 833 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaacaatggccaccacctgctggggggtcaagccgtgggcctggcacagcaccggcaacagccgctggaccgtctccagcgcctgcttgccgccatttggccatggaagcttttcagacagcccttttctaaatagcctggtgggacacatcttgcattcctcaattcttgtgccataccatggatggttagttcatcccggctttttgtttgtcatggaagttcttttattgattcaatttttatagcgtgttcggaaaacgcgtttcagaaaataatgaaatacatcttgaatctgaaagttataacttttagcttcattgtcattgaaagttcttttattaattatattttattgcgtgtttggaatcccatttgagaaataagaaatcacgtttaaaatgtgaaagttataactattaactttgactaaacttgaaaaaattcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaacggaatctttatacttcagataaagctgttcttgaacatttttttcgtcattatcttagttaaccgagaag

SEQ ID NO: 352 - DNA, 721 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaagggaatctttatacttcagataaagctgttcttgaacattttttttagtc

SEQ ID NO: 353 - DNA, 494 bp, Artificial
  Glycine max FAD3A mutation created with TALEN pair GmFAD3_T01.1
cactgctttgttatgcctacctcattccatggaagcttttcagacagcccttttctaaatagcctggtgggacacatcttgcattcctcaattcttgtgccataccatggatggttagttcatcccggcttttttgtttgtcattggaagttcttttattgattcaattttttatagcgtgttcggaaacgcgtttcagaaaataatgaaatacatcttgaatctgaaagttataactttttagcttcattgtcattgaaagttcttttattaattatatttttattgcgtgtttggaatcccatttgagaaataagaaatcacgtttaaaatgtgaaaagttataactattaacttttgactaaaacttgaaaaaattcacatttttgatgtggaaccaaatctgattttgagaaccaagttgatttttgatggatttttgcaggagaattagccacagaactcaccatcaaaaatcatggacacattgagaa

SEQ ID NO: 354 - DNA, 627 bp, Artificial
  Glycine max FAD3A mutation created with TALEN pair GmFAD3_T01.1
cactgtttgttatgcctacctcatttcatttggctttagacaacttaaatttgagatctttattatgttttttgcttatatggtaaagtgattcattcttcacattgaattcatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatattttattgcgtgtttggaatcccatttgagaaataagaaatcacgtttaaaattgtgaaagttataactattaacttttgactaaacttgaaaaaactcacatttttgatgtggaaccaaatctgatttgagaaccaagttgatttgatggattttgcaggagaattagccacagaactcaccatcaaaatcatggacacattgagaaggatgaatcctgggttccagtatgtgattaactacttcctctatagttatttttga

SEQ ID NO: 355 - DNA, 696 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaatgtgaagttataactattaactttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttacttgaacatttttttgtcattatcttagttaacc

SEQ ID NO: 356 - DNA, 610 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttcttttattaattatatttttaattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaaatcatggacacattgagaaggatgaatcctgggttccagtatgtgattaagtacttcctctatagttatttttggattcaa

SEQ ID NO: 357 - DNA, 726 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatattttattgcgtgtttggaatcccatttgagaaataagaaatcacgtttaaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttattaataagttcaagaaaaaagggaatctttatacttcagataaagctgttcttgaacattttttttagtcattatcttagttaaccga

SEQ ID NO: 358 - DNA, 690 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttcttttattaattatattttattgcgtgtttggaatcccatttgagaaataagaaatcacgtttaaaaatgtgaaagttataactattaacttttgactaaacttgaaaaaatcacattttgatgtggaaccaaatctgatttgagaaccaagttgattttgatggattttgcaggagaattagccacaagaactcaccatcaaaaatcatggacacattgagaaggatgaatcctgggttccagtatgtgattaactacttcctctatagttattttgattcaattaaaatttatttattaataagttcaagaaaaaaaggaatctttatacttcagataaagctg

SEQ ID NO: 359 - DNA, 707 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattcatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaattgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttattattaataagttcaagaaaaaggaatcttatacttcagataaagctgttcttgaacatttttttt

SEQ ID NO: 360 - DNA, 685 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtcaagccgtggccatggaagcttttcagacagccctttttctaaatagcctggtgggacacatcttgcattcctcaattcttgtgccataccatggatggttagttcatcccggcttttttgtttgtcattggaagttcttttattgattcaattttttatagcgtgttcggaaacgcgtttcagaaataatgaaatacatcttgaatctgaaagttataacttttagcttcattgtcattgaaagttcttttattaattatatttttattgcgtgtttggaatcccatttgagaaaataagaaatcacgtttaaaatgtgaagttataactattaacttttgactaaacttgaaaaaatcacattttgatgtggaaccaaatctgatttgagaaccaagttgattttgatggattttgcaggagaattagccacagaactcaccatcaaaaatcatggacacattgagaaggatgaatcctgggttccagtatgtgattaactacttcctctatagttatttttgattcaattaaatttattatttaataagttcaagaaaaaggaatctttatacttcagataaagctgttacttgaac

SEQ ID NO: 361 - DNA, 630 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaattgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttt

SEQ ID NO: 362 - DNA, 669 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattcctcaattcttgtgccataccatggatggttagttcatcccggctttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaaatgtgaaaagttataactattaacttttgactaaacttgaaaaaatcacatttttgatgtggaaccaaatctgattgagaaccaagttgattttgatggattttgcaggagaattagccacagaactcaccatcaaaatcatggacacattgagaaggatgaatcctgggttccagtatgtgattaactacttcctctatagttatttttgattcaattaatttatttatttaataagttcaagaaaaaatggaatctttatacttcagataaagctgtcttgaacatttttttttgtcattatctagttt

SEQ ID NO: 363 - DNA, 790 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgagctgttgccggtgctgtgccaggcccacggcttgaccccggagcaggtggtggccatcgccagccacgatggcggcaaggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaattatttattataagtcaagaaaaagggaatctttatacttcagataaagctgttcttgaacattttttttt

SEQ ID NO: 364 - DNA, 719 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaatggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaattgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaagggaatctttatacttcagataaagctgttcttgaacatttttttt

SEQ ID NO: 365 - DNA, 604 bp, Artificial
  Glycine max FAD3A mutation created with TALEN pair GmFAD3_T01.1
cactgctttgttatcgctacctcatttcatttggcacagcaccggcaacagccgctggaccgtctccagcgcctgcttgccaccaatattgctggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatattttattgcgtgtttggaatcccatttgagaaataagaaatcacgtttaaaaattgtgaaagttataactattaacttttgactaaacttgaaaaaactcacatttttgatgtggaaccaaatctgattttgagaaccaagttgattttgatggattttgcaggagaattagccacagaactcaccatcaaaatcatggacacattgagaaggatgaatcctgggttccagtatgtgattaactacttcctctatag

SEQ ID NO: 366 - DNA, 700 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaatttggccatggaagcttttcagacagcccttttctaaatagcctggtgggacacatcttgcattcctcaattcttgtgccataccatggatggttagttcatcccggcttttttgtttgtcattggaagttcttttattgattcaattttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggaaaattagccacagaactcaccatcaaaatcatggacacattgagaaggatgaatcctgggttccagtatgtgattaactacttcctctatagttattttgattcaattaaaatttatttatttaataagttcaagaaaaaagggaatctttatacttcagataaagctgttc

SEQ ID NO: 367 - DNA, 679 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattggtatttcacaccgcatatggtgcactctcagtacaatctgctctgatgccgcatagttaagccagccccgacacccgccaacacccgctgacgcgccctgacgggcttgtctgctcccggcttccgcttacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatattttattgcgtgttggaatcccatttgagaaatagaaatcacgtttaaaatgtgaaagttataactattaacttttgactaaacttgaaaaaaagtcacatttttgatgtggaaaccaaatctgatttgagaaccaagttgattttgatggattttgcaggagaattagccatcagaac

SEQ ID NO: 368 - DNA, 697 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaatgtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaaggaatctttatacttcagataaagctg

SEQ ID NO: 369 - DNA, 720 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgagtgccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaaattgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacatttgagaaggattgaatcctgggttccagtatgtgattaactacttcctctatagttattttgattcaattaaatttatttattaataagttcaagaaaaaaggaatctttatacttcagataaagctgttcttgaacatttttttt

SEQ ID NO: 370 - DNA, 539 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgacacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaactttgactaaacttgaaaaaatcacattttgatgtggaaccaaattctgatttgagaaccaagttgattttgatggattttgcaggagaattagccacagaactcaccatcaaaatc

SEQ ID NO: 371 - DNA, 730 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaaattgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaagggaatctttatacttcagataaagctgttcttgaacattttttttagtcattatcttag

SEQ ID NO: 372 - DNA, 739 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaacaccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataactttttagcttcattgtcattgaaaagttctttttattaattatatttttattgcgtgtttggaatcccatttgagaaataagaaatcacgtttaaaaattgtgaaagttataactattaacttttgactaaacttgaaaaaatcacatttttgatgtggaaccaaatctgatttgagaaccaagttgattttgatggattttgcaggagaattagccacagaactcaccatcaaaaatcatggacacattgagaaggatgaatcctgggttccagtatgtgattaactacttcctctatagttatttttgattcaattaaatttatttattaataagttcaagaaaaagggaatctttatacttcagataaagctgttcttgaacattttttttagtcattatcttagttaa

SEQ ID NO: 373 - DNA, 603 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattcagtggccatggaagcttttcagacagcccttttctaaatagcctggtgggacacatcttgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggatgaattagccacagaactcaccatcaaaatcatggacacattgagaaggatgaaatcctgggttccagtat

SEQ ID NO: 374 - DNA, 650 bp, Artificial
  Glycine max FAD3A mutation created with TALEN pair GmFAD3_T01.1
cactgctttgttatgcctacctcaattcaatgtgaagaatgaatcactttaccatataagcaaaaaacataataaagatctcaaatttaagttgtctaaatcactttaaacgtgatttcttgcattcctcaattcttgtgccataccatggatggttagttcatcccggctttttttgtttgtcattggaagttctttttattgattcaatttttatagcgtgttcggaaacgcgttttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgattgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaatggaatctttatacttcagataaagct

SEQ ID NO: 375 - DNA, 681 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatagtggccatggaagcttttcagacagcccttttctaaatagcctggtgggacacatcttgcattcctcaattcttgtgccataccatggatggttagttcatcccggcttttttgtttgtcattggaagttcttttattgtatttcaattttatagctgtgttcggaaacgcgtttcagaaaataatgaaatacatcttgaatctgaaagttataacttttagcttcattgtcattgaaaagttcttttattaattatatttttaattgcgtgtttggaatcccatttgagaaaataagaaatcacgtttaaaatgtgaaagttataactattaactttgactaaacttgaaaaaatcacattttgatgtggaaccaaatctgatttgagaaccaagttgattttgatggattttgcaggagaattagccacagaactcaccatcaaaaatcatggacacattgagaaggatgaatcctgggttccagtatgtgattaactactcctctatagttattttgattcaattaaatttatttatttaataagttcaagaaaaaagggaatctttatacttcagataaagctgttcttgaaca

SEQ ID NO: 376 - DNA, 560 bp, Artificial
  Glycine max FAD3A mutation created with TALEN pair GmFAD3_T01.1
cactgctttgttatgcctacctcattccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaattaagaaatcacgtttaaaatgtgaaaagttataactattaacttttgactaaaacttgaaaaaattcacatttttgatgtggaaccaaatctgatttgagaaccaagttgattttgatggatttttgcaggagaattagccacagaactcaccatcaaaatcatggacacattgagaaggatgaattcctgggttccagtatgtgattaactacttcctctatagttatttttgattcaattaattta

SEQ ID NO: 377 - DNA, 733 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaattgtgaaagttataactattaacttttgactaaacttgaaaaaactcacatttttgatgtggaaccaaatctgatttgagaaccaagttgattttgatggattttgcagagaattagccacagaactcaccatcaaaatcatggacacattgagaaggatgaatcctgggttccagtatgtgattaactacttcctctatagttattttgattcaattaaatttattattaataagttcaagaaaaaggaatctttatacttcagataaagctgtcttgaacatttttttagtcattatcttagttaaccgag

SEQ ID NO: 378 - DNA, 711 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatattttattgcgtgtttggaatcccatttgagaaataagaaatcacggtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttattaataagttcaagaaaaaggaatcttatacttcagataaagctgttcttgaacatttttttt

SEQ ID NO: 379 - DNA, 732 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttattattaataagttcaagaaaaaggaatctttatacttcagataaagctgttcttgaacattttttttgtcattatcttagttaaccgag

SEQ ID NO: 380 - DNA, 704 bp, Artificial
  Glycine max FAD3A mutation created with TALEN pair GmFAD3_T01.1
  misc_feature (670): n is a or c or t or g
cactgctttgttatgcctacctcatttcatttggctttagacaacttaaatttgagatctttattatgttttttgcttatatggtaaagtgattcattcttcacattgaatcatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatattttattgcgtgtttggaatcccatttgagaaataagaaatcacgtttaaaattgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttattaataagttcaagaaaaggaatcttntacttcagataaagctgttcttgaacattttttt

SEQ ID NO: 381 - DNA, 732 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaatgccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgttgatgacccatttgagaaataagaaatcacgtttaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaaggaatctttatacttcagataaagctgttcttgaacattttttttgtcattatcttagttaaccgag

SEQ ID NO: 382 - DNA, 720 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaagtccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataactttttagcttcattgtcattgaaagttctttttattaattatatttttattgcgtgtttggaatcccatttgagaaataagaaatcacgtttaaaaattgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaagggaatctttatacttcagataaagctgttcttgaacatttttttt

SEQ ID NO: 383 - DNA, 574 bp, Artificial
  Glycine max FAD3A mutation created with TALEN pair GmFAD3_T01.1
cactgctttgttatgcctacctcatttcatttggctttagacaacttaaatttgagatctttattatgttctttgcttatatggaagcttttcagacagcccttttctaaatagcctggtgggacacatcttgcattcctcaattcttgtgccatacgcatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttcttttattaattatatttttattgcgtgtttggaatcccatttgagaaaataagaaatcacgtttaaaaatgtgaaagttataactattaacttttgactaaacttgaaaaaatcacattttgatgtggaaccaaatctgatttgagaaccaagttgattttgatggattttgcaggagaattagccacagaactcaccatcaaaaatcatggacacattgagaaggatgaatcctgggttccagtatgtgattaact

SEQ ID NO: 384 - DNA, 745 bp, Artificial
  Glycine max FAD3A mutation created with TALEN pair GmFAD3_T01.1
  misc_feature (140): n is a or c or t or g
cactgctttgttatgcctacctcatttcatttggctttagacaacttaaatttgagatctttattatgttttttgcttatatggtaaagtgattcattcttcacattgaatcatggaagcttttcagacagcccttttcnaaaatagcctggtgggacacatcttgcattcctcaattcttgtgccataccatggatggttagttcatccccgggcttttttgtttgtcattggaagttcttttattgattcaattttatagcgtgttcggaaacgcgttcagaaaataatgaaatacatcttgaatctgaaagttataacttttagcttcattgtcattgaaagttctttttatttaaattatatttttattgcgtgtttggaaatcccatttgagaaataagaaatcacgtttaaaaattgtgaaagttataactattaacttttgactaaacttgaaaaaactcacatttttggatgtggaaccaaaatctgatttgagaaccaagttgattttgatggattttgcaggagaattagccacagaactcaccatcaaaaatcatggacacatgagaaggatgaatcctgggttccagtatgtgattaactacttcctctatagttattttgattcaattaaaatttatttatttaataagttcaagaaaaaaagggaatctttatacttcagataaagctgttcttgaacattttttttagtcattatcttagtttaaccgag

SEQ ID NO: 385 - DNA, 584 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaacaatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaat

SEQ ID NO: 386 - DNA, 889 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaacagccgctggaccgtctccagcgcctgcttgccgccatcgtggctggcgatggccaccacctgctccggggtcaagccgtgggcctggcacagcaccggcaacagccgctggaccgtctccagcgcctgcttgccgccatcgtggtggccatggaagcttttcagacagcccttttctaaaatagcctggtgggacacatcttgcattcctcaattcttgtgccataccatggatggttagttcatcccggctttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcgcgtttaaaatgtgaaagttataactattaacttttgactaaacttgaaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaaggaatctttatacttcagataaagctgttcttgaacaatttttttgtcattatcttagttaaccgagaaag

SEQ ID NO: 387 - DNA, 711 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttattaataagttcaagaaaaaggaatctttatacttcagataaagctgttcttgaacatttttttt

SEQ ID NO: 388 - DNA, 591 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacattttgatgtggaaccaaatctgattttgagaaccaagttgattttgatggattttgcaggagaattagccacagaactcaccatcaaaatcatggacacattgagaaggatgaatcctggg

SEQ ID NO: 389 - DNA, 686 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgtggcgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggtggccatggaagcttttcagacagcccttttctaaatagcctggtgggacacatcttgcattcctcaattcttgtgccataccatggatggttagttcatcccggctttttgtttgtcatggaagttctttattgattcaattttatagcgtgttcggaaacgcgtttcagaaataatgaatacatcttgaatctgaaagttataactttagcttcattgtcattgaaagttcttttattaattatattttattgcgtgtttggaatcccatttgagaataagaaatcacgtttaaaatgtgaaagttataactattaactttgactaaacttgaaaaatcacatttttgatgtggaaccaaatctgatttgagaaccaagttgatttttgatggatttttg

SEQ ID NO: 390 - DNA, 702 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaatggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaaatgtgaaagttataactattaacttttgactaaacttgaaaaaatcacatttttgatgtggaaccaaatctgatttgagaaccaagttgattttgatggattttgcaggagaattagccacagaactcaccatcaaaaatcatggacacattgagaaggatgaatcctgggttccagtatgtgattaactacttcctctatagttatttttgattcaattaaatttatttatttaataagttcaagaaaaaaggaatctttatacttcagataaagctg

SEQ ID NO: 391 - DNA, 737 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaaatgtgaaagttataactattaacttttgactaaacttgaaaaaatcacatttttgatgtggaaccaaatctgatttgagaaccaagttgattttgatggattttgcaggagaattagccacagaactcaccatcaaaaatcatggacacattgagaaggatgaatcctgggttccagtatgtgattaactacttcctctatagttattttgattcaattaaatttatttattaataagttcaagaaaaaaggaatctttatacttcagataaagctgttcttgaacattttttttgtcattatcttagttaaccgag

SEQ ID NO: 392 - DNA, 627 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaaattgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagtta

SEQ ID NO: 393 - DNA, 709 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatattttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaagggaatctttatacttcagataaagctgttcttgaacattttttt

SEQ ID NO: 394 - DNA, 705 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaatccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatattttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttattattaataagttcaagaaaaaggaatcttatacttcagataaagctgttcttgaacattttttt

SEQ ID NO: 395 - DNA, 822 bp, Artificial
  Glycine max FAD3A mutation created with TALEN pair GmFAD3_T01.1
  misc_feature (346): n is a or c or t or g
cactgctttgttatgcctacctcatttcatttggctttagacaacttaaatttgagatctttattatgttttttgcttatatggtaaagtgattcattcttcacattgaatcaccggcaacagccgctggaccgtctccagcgcctgcttgccgccatcgtggctggcgatggccaccacctgctccggggtcaatggccatggaagcttttcagacagcccttttctaaatagcctggtgggacacatcttgcattcctcaattcttgtgccataccatggatggttagttcatcccggcttttttgtttgtcattggaagttcttttattgattcaatttttanagcgtgttcggaaaacgcgtttcagaaaataatgaaatacatcttgaatctgaaagttataacttttagcttcattgtcattgaaagttcttttattaattatattttattgcgtgtttggaatcccatttgagaaataagaaatcacgtttaaaatgtgaaagttataactattaacttttgactaaacttgaaaaattcacattttgatgtggaaccaaatctgatttgagaaccaaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaacggaatctttatacttcagataaaggctgttcttgaacatttttttcgtcattatcttagtaaccgagaag

SEQ ID NO: 396 - DNA, 737 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacataacaggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttctttttattaattatatttttattgcgtgtttggaatcccatttgagaaataagaaatcacgtttaaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaaaggaatctttatacttcagataaagctgttcttgaacattttttttgtcattatcttagttaaccgag

SEQ ID NO: 397 - DNA, 741 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaatggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaagggaatctttatacttcagataaagctgttcttgaacatttttttagtcattatcttagttaaccgag

SEQ ID NO: 398 - DNA, 628 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataactttttagcttcattgtcattgaaaagttctttttattaattatatttttattgcgtgtttggaatcccatttgagaaataagaaatcacgtttaaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagtta

SEQ ID NO: 399 - DNA, 730 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttattaataagttcaagaaaaaggaatcttatacttcagataaagctgttcttgaacatttttttgtcattatcttagttaaccgag

SEQ ID NO: 400 - DNA, 714 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgacatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatattttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaagggaatctttatacttcagataaagctgttcttgaacatttttttt

SEQ ID NO: 401 - DNA, 727 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacatcatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttattaataagttcaagaaaaaagggaatctttatacttcagataaagctgttcttgaacattttttttgtcattatcttagttaaccgag

SEQ ID NO: 402 - DNA, 763 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaggcgctggagacggtccagcggctgttgccggtgctgtgccaggcccagtggccatggaagcttttcagacagcccttttctaaatagcctggtgggacacatcttgcattcctcaattcttgtgccataccatggatggttagttcatcccggctttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccattgagaaataagaaatcacgtttaaaatgtgaaagttataactattaactttgactaaacttgaaaaaagtcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaagggaatctttatacttcagataaagctgttcttgaacatttttttt

SEQ ID NO: 403 - DNA, 699 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtatggaagcttttcagacagcccttttctaaatagcctggtgggacacatcttgcattcctcaattcttgtgccataccatggatggttagttcatcccggcttttttgtttgtcattggaagttcttttattgattcaattttttatagcgtgttcggaaacgcgtttcagaaataatgaaatacatcttgaatctgaaagttataacttttagcttcattgtcattgaaagttcttttattaattatatttttaattgcgtgtttggaatcccatttgagaaataagaaatcacgtttaaatgtgaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttacttgaacattttttttagtcattatcttagttaa

SEQ ID NO: 404 - DNA, 738 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgagccccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgattttgagaaccaagttgattttgatggattttgcaggagaattagccacagaactcaccatcaaaatcatggacacattgagaaggattgaatcctgggttccagtatgtgattaactacttcctctatagttatttttgattcaattaaatttatttattaataagttcaagaaaaaggaatcttatacttcagataaagctgttcttgaacatttttttgtcattatcttagttaaccgag

SEQ ID NO: 405 - DNA, 724 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacatcatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatattttattgcgtgtttggaatcccatttgagaaataagaaatcacgtttaaaatgtgaaagttataactattaacttttgactaaacttgaaaaaatcacattttgatgtggaaccaaatctgattttgagaaccaagttgaattttgatggattttgcaggagaattagccacagaactcaccatcaaaatcatggacacattgagaaggatgaatcctgggttccagtatgtgattaactacttcctctatagttatttttgattcaattaaatttatttattaataagttcaagaaaaaggaatcttatacttcagataaagctgattcttgaacattttttttgtcattatcttagttaaccgag

SEQ ID NO: 406 - DNA, 734 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgacatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatattttattgcgtgtttggaatcccatttgagaaataagaaatcacgtttaaaaatgtgaaagttataactattaacttttgactaaacttgaaaaaactcatcatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttattattaataagttcaagaaaaaggaatctttatacttcagataaagctgttcttgaacattttttttagtcattatcttagttaaccgag

SEQ ID NO: 407 - DNA, 733 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaaggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgattttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttattaataagttcaagaaaaaggaatcttatacttcagataaagctgattcttgaacattttttttgtcattatcttagttaaccgag

SEQ ID NO: 408 - DNA, 584 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcc

SEQ ID NO: 409 - DNA, 731 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatattttattgcgtgtttggaatcccatttgagaaataagaaatcacgtttaaaattgtgaaagttataactattaacttttgactaaacttgaaaaaactcacatttttgatgtggaaccaaatctgattttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaagggaatctttatacttcagataaagctgttcttgaacatttttttagtcattatcttagttaaccgag

SEQ ID NO: 410 - DNA, 634 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattcctcaattcttgtgccataccatggatggttagttcatcccggctttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatattttttattgcgtgtttggaatcccatttgagaaataagaaatcacgtttaaaatgtgaaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttcgattcaattaaattttatttatttaataagttcaagaaaaaaaggaatctttatacttcagat

SEQ ID NO: 411 - DNA, 730 bp, Artificial
  Glycine max FAD3A mutation created with TALEN pair GmFAD3_T01.1
  misc_feature (646): n is a or c or t or g
cactgctttgttatgcctacctcatttcatttggctttagacaacttaaatttgagatctttattatgttttttgcttatatggtaaagtgattcattcttcacattgaattggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttnttaataagttcaagaaaaaaggaatctttatactcagataaagctgtcttgaacatttttttgtcttatcttagaaccgagaag

SEQ ID NO: 412 - DNA, 623 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaatcatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaaattgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagtta

SEQ ID NO: 413 - DNA, 662 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaacagacagtggccatggaagcttttcagacagcccttttctaaatagcctggtgggacacatcttgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttattt

SEQ ID NO: 414 - DNA, 524 bp, Artificial
  Glycine max FAD3A mutation created with TALEN pair GmFAD3_T01.1
cactgctttgttatgcctacctcatttcatttggctttagacaacttaaatttgagatctttattatgttttcaggctattttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgttttcagaaaataatgaaatacatcttgaatctgaaagttataactttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgattgagaaccaagttgattttgatggattttgcaggagaattagccacagaactcaccatcaaaatcatggacacatt

SEQ ID NO: 415 - DNA, 701 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaatggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattggagaaggattgaatcctgggttccagtatgtgattaactacttcctctatagttattttgattcaattaaatttatttatttaataagttcaagaaaaaaggaatctttatacttcagataaagctg

SEQ ID NO: 416 - DNA, 736 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgattttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaaggaatctttatacttcagataaagctgattcttgaacatttttttgtcattatcttagttaaccgag

SEQ ID NO: 417 - DNA, 689 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaaggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttattaataagttcaagaaaaaggaatctttatacttcagataaagc

SEQ ID NO: 418 - DNA, 734 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgatggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaaattatatttttattgcgtgtttggaatcccatttgagaaataagaaatcacgtttaaaaattgtgaaagttataactattaacttttgactaaacttgaaaaaactcacatttttgatgtggaaccaaatctgatttgagaaccaagttgattttgatggattttgccaggagaattagccacagaactcaccatcaaaaatcatggacacattgagaaggatgaatcctgggttccagtatgtgattaactacttcctctatagttattttgattcaattaaatttattattaataagttcaagaaaaagggaatctttatacttcagataaagctgttcttgaacattttttttagtcattatcttag

SEQ ID NO: 419 - DNA, 509 bp, Artificial
  Glycine max FAD3A mutation created with TALEN pair GmFAD3_T01.1
  misc_feature (468): n is a or c or t or g
cactgctttgttatgcctacctcatttcatttggctttagacaacttaaatttgagatctttattatgttttttgcttatatggtaaagtgattcattcttcacattgaattgaaaccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatattttattgcgtgtttggaatcccatttgagaataagaaatcacgtttaaaatgtgaaagttataatctattaacttttgactaaacttgaaaaaatcaacnttttgaatgtggaaccaaattctgattttgagaaccaagtt

SEQ ID NO: 420 - DNA, 550 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaatggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgattttgagaaccaagttgattttgatggattttgcatggagaattagccacagaactcacca

SEQ ID NO: 421 - DNA, 738 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaccatggaagcttttcagacagcccttttctaaatagcctggtgggacacatcttgcattcctcaattcttgtgccataccatggatggttagttcatcccggcttttttgtttgtcattggaagttcttttattgattcaattttatagcgtgttcggaaacgcgtttcagaaaataagaaatacatcttgaatctgaaagttataacttttagcttcattgtcattgaaagttctttttattaattatatttttattgcgtgtttggaatcccatttgagaaataagaaatcacgtttaaaaattgtgaaagttataactattaactttttgactaaacttgaaaaaatcacatttttgatgtggaaccaaatctgatttgagaaccaagttgattttgatggattttgcaggagaattagccacgaactcaccatcaaaatcatggacacatgagaaggatgaatccttgggttccagtatgtgattaactacttcctctatagttattttgattcaattaaatttatttatttaataagttcaagaaaaaagggaatctttatacttcagataaagctgttcttgaacattttttttagtcattatcttagtttaaccgag

SEQ ID NO: 422 - DNA, 711 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaggccatggaagcttttcagacagcccttttctaaatagcctggtgggacacatcttgcattcctcaattcttgtgccataccatggatggttagttcatcccggcttttttgtttgtcattggaagttcttttattgattcaattttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttattattaataagttcaagaaaaaggaatcttatacttcagataaagctgttcttgaacattttttt

SEQ ID NO: 423 - DNA, 634 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaatggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatattttattgcgtgtttggaatcccatttgagaaataagaaatcacgtttaaaaattgtgaaagttataactattaacttttgactaaacttgaaaaaactcacatttttgatgtggaaccaaatctgatttgagaaccaagttgatttgatggattttgcagagaattagccacagaactcaccatcaaaatcatggacacattgagaaggattgaatcctgggttccagtatgtgattaactacttcctctatagttattttt

SEQ ID NO: 424 - DNA, 726 bp, Artificial
  Glycine max FAD3A mutation created with TALEN pair GmFAD3_T01.1
cactgctttgttatgcctacctcatttcatttggctttagacaacttaaatttgagatctttattatgtttttttgcttatatggtaaagtgattcattcttcacattgaatcaccggcaacagccgctggaccgtctccagcgcctgcttgccgccatcgtggctggcgatggccaccacctgctccggggtcaatggccatggaagcttttcagacagccctttttctaaatagcctggtgggacacatcttgcattcctcaattcttgtgccataccatggatggttagttcatcccggcttttttgtttgtcattggaagttctttttattgattcaatttttatagcgtgttcggaaaacgcgtttcagaaaaataatgaaatacatcttgaatctgaaagttataacttttagcttcattgtcattgaaagttcttttattaattatatttttattgcgtgtttggaatcccatttgagaaataagaaatcacgtttaaaatgtgaaagtttataactattaacttttgactaaacttgaaaaaaattcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaa

SEQ ID NO: 425 - DNA, 708 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgacatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttattattaataagttcaagaaaaaggaatctttatacttcagataaagctgttcttgaacattttttt

SEQ ID NO: 426 - DNA, 716 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaaattgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttattaataagttcaagaaaaaggaatctttatacttcagataaagctgttcttgaacattttttt

SEQ ID NO: 427 - DNA, 529 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgtggcgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggtggccatggaagcttttcagacagcccttttctaaatagcctggtgggacacatcttgcattcctcaattcttgtgccataccatggatggttagttcatcccggctttttgtttgtcattggaagttcttttattgattcaatttttatagcgtgttcggaaacgcgtttcagaaataatgaatacatcttgatctgaaagttataacttttagcttcattgtcattgaaagttcttttattaa

SEQ ID NO: 428 - DNA, 772 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaatgacagcgacggtccctaacgctgccgggtgttggcttaacgcaacgatgtgcgcgtgtgtaaacccgtggccgaccagtgcctcgtggtgccatggaagcttttcagacagcccttttctaaatagcctggtgggacacatcttgcattcctcaattcttgtgccataccatggatggttagttcatcccggcttttttgtttgtcattggaagttctttttattgattcaatttttatagcgtgttcggaaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaactttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatac

SEQ ID NO: 429 - DNA, 682 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgagccatggaagcttttcagacagccctttctaaatagcctggtgggacacatcttgcattcctcaattcttgtgccataccatggatggttagttcatcccggcttttttgtttgtcattggaagttcttttattgattcaatttttatagcgttgttcggaaacgcgtttcagaaaataatgaaatacatcttgaatctgaaagttataacttttagcttcattgtcattgaaaagttcttttattaattatattttattgcgtgtttggaatcccatttgagaaataagaaatcatcgtttaaaaatgtgaaagttataactattaactttgactaaacttgaaaaatcacattttgatgtggaaccaaatctgatttgagaaccaagttgatttgatggattttgcatgagaattagccacagaactcaccatcaaaatcatggacacattgagaaggatgaatcctgggttccagtatgtgattaactacttcctctatagttattttgattcaattaaatttatttattaataagttcaagaaaaaaggaatcttatacttcag

SEQ ID NO: 430 - DNA, 765 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgatccctttttcactgcatccagcgcaggacgcccgccgaggcaggccaaggcgacgaggtggtcgttggtcaacgcggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatgggattttgcaggagaattagccacagaactcaccatcaaaatcatggacacattgagaaggatgaatcctgggttccagtatgtgattaactacttcctctatagttatttttgattcaattaaatttatttatttataagttcaagaaaaaaggaatctttatacttcagat

SEQ ID NO: 431 - DNA, 720 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacatgtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaattgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttattattaataagttcaagaaaaaggaatcttatacttcagataaagctgttcttgaacatttttttagtcattatcttag

SEQ ID NO: 432 - DNA, 596 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcagacagcccttttctaaatagcctggtgggacacatcttgcattcctcaattcttgtgccataccatggatggttagttcatcccggctttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttaattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccatcaggaatctcaccatcaaaatcatggacacattgaagaaggatgaatcctgggttccagtatgtgattaactgacttcctctatag

SEQ ID NO: 433 - DNA, 661 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgccggcaacagccgctggaccgtctccagcggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaatt

SEQ ID NO: 434 - DNA, 736 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataactttttagcttcattgtcattgaaaagttctttttattaattatatttttattgcgtgtttggaatcccatttgagaaataagaaatcacgtttaaaatgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttattaataagttcaagaaaaaggaatcttatacttcagataaagctgttcttgaacattttttttagtcattatcttagttaaccgag

SEQ ID NO: 435 - DNA, 734 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatattttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaaggaatctttatacttcagataaagctgttcttgaacattttttttgtcattatcttagttaaccgag

SEQ ID NO: 436 - DNA, 726 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttcttttattaattatattttattgcgtgtttggaatcccatttgagaaataagaaatcacgtttaaaatgtgaaagttataactattaacttttgactaaacttgaaaaaatcacatttttgatgtggaaccaaatctgattttgagaaccaagttgatttgatggattttgcaggagaattagccacagaactcaccatcaaaatcatggacacattgagaaggatgaatcctgggttccagtatgtgattaactacttcctctatagttatttttgattcaattaaatttattattaataagttcaagaaaaaagggaatcttatacttcagataaagctgttcttgaacatttttttagtcattatcttagttaaccgag

SEQ ID NO: 437 - DNA, 730 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatattttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttattattaataagttcaagaaaaaggaatcttatacttcagataaagctgttcttgaacatttttttagtcattatcttagttaaccgag

SEQ ID NO: 438 - DNA, 624 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagtta

SEQ ID NO: 439 - DNA, 715 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcagacagcccttttctaaatagcctggtgggacacatcttgcattcctcaattcttgtgccataccatggatggttagttcatcccggcttttttgtttgtcattgggaagttcttttattgattcaattttttatagcgtgttcggaaacgcgtttcagaaataatgaaatacatcttgaatctgaaagttataacttttagcttcattgtcattgaaagttcttttattaattatatttttattgcgtgtttggaatcccatttgagaaataagaaatcacgtttaaatgtgaaagttataactattaacttttgactaaacttgaaaaaatcacattttgatgtggaaccaaatctgatttgagaaccaagttgattttgatggattttgcaggagaattagccacagaactcaccatcaaaaatcatggacacattgagaaggatgaatcctgggttccagtatgtgattaactacttcctctatgttatttttgattcaattaaaatttatttatttaaataagttcaagaaaaaaatgggaattctttatacttcagataaagctgttcttgaacatttttttagtcattatcttagttaaccgagaa

SEQ ID NO: 440 - DNA, 732 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacatcatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaattgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaagggaatctttatacttacagataaagctgttcttgaacattttttttagtcattatcttagttaaccgag

SEQ ID NO: 441 - DNA, 710 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaaagggaatctttatacttcagataaagctgttcttgaacatttttttt

SEQ ID NO: 442 - DNA, 733 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatattttattgcgtgtttggaatcccatttgagaaataagaaatcacgtttaaaatgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttattattaataagttcaagaaaaaagggaatctttatacttcagataaagctgttcttgaacattttttttagtcattatcttagttaaccgag

SEQ ID NO: 443 - DNA, 510 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaacacctgctggggggtcaagccgtgggcctggcacagcaccggcaacagccgctggaccgtctccagcgcctgcttgccaccgccattgctggcgatggccaccacctgctgggggggtcaagccgtgggcctggcacagcaccggggccatggaagcttttcagacagcccttttctaaatagcctggtgggacacatcttgcattcctcaattcttgtgccataccatggatggttagttcatcccggctttttggtttgtcattggaagttcttttattgattcaatttttatagcgtgttcggaaacgcgtttcagaaataatgaaatacatcttgaatctgaagttataactttagcttcattgtcattgaaagttcttttattaattata

SEQ ID NO: 444 - DNA, 710 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttattaataagttcaagaaaaaggaatcttatacttcagataaagctgttcttgaacattttttt

SEQ ID NO: 445 - DNA, 743 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaacagacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacatttttttcgtcattatctagttaaccg

SEQ ID NO: 446 - DNA, 739 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgagccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttcttttatttaattatatttttattgcgtgtttggaatcccatttgagaaataagaaatcacgtttaaaaattgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttattaataagttcaagaaaaaaggaatcttatacttcagataaagctgttcttgaacatttttttgtcattatcttagttaaccgagaag

SEQ ID NO: 447 - DNA, 627 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgattttgagaaccaagttgattttgatggattttgcaggagaattagccacagaactcaccatcaaaatcatggacacattgagaaggattgaatcctgggttccagtatgtgattaactacttcctctatagtta

SEQ ID NO: 448 - DNA, 681 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaatagctgttgccaccattattgctggcgatggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaat

SEQ ID NO: 449 - DNA, 737 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttattaataagttcaagaaaaaaggaatctttatacttcagataaagctgttcttgaacattttttttgtcattatcttagttaaccgag

SEQ ID NO: 450 - DNA, 778 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaatgtcaagccgtgggcctggcacagcaccggcaacagccgctggaccggaagcttttcagacagcccttttctaaatagcctggtgggacacatcttgcattcctcaattcttgtgccataccatggatggttagttcatcccggctttttgtttgtcattggaagttcttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcggagaattagccacagaactcaccatcaaaatcatggacacattgagaaggatgaatcctgggttccagtatgtgattaactacttcctctatagttatttttgattcaattaaatttatttatttataagttcaagaaaaaagggaatctttatacttcagataaagctgttctttgaacattttttttgtcattattctagtttaaccga

SEQ ID NO: 451 - DNA, 710 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaactaagttgatttgatggattttgcaggagaattagccacagaactcaccatcaaatcatggacacattgagaaggatgatcctgggtccagtatgtgattaactacttcctctatagttattttgattcaattaaatttatttatttaataagttcaagaaaaaaagggaatctttatacttcagataaagctgttcttgaacattttttt

SEQ ID NO: 452 - DNA, 592 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggtcc

SEQ ID NO: 453 - DNA, 628 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaatggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagtta

SEQ ID NO: 454 - DNA, 590 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatattttattgcgtgtttggaatcccatttgagaaattaagaaatcacgtttaaaaattgtgaaagttataactattaacttttgactaaacttgaaaaaactcacatttttgatgtggaaccaaatctgatttgagaaccaagttgatttgatggattttgcaggagaattagccacagaactcaccatcaaaatcatggacacattgagaaggattgaatcctggg

SEQ ID NO: 455 - DNA, 713 bp, Artificial
  Glycine max FAD3A mutation created with TALEN pair GmFAD3_T01.1
cactgctttgttatgcctacctcatttcatttggctttagacaacttaaatttgagatctttattatgtttttttgcttatatggtaaagtgattcattcttcacattgaattgagccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaaattgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttattattataagttcaagaaaaaggaatctttatacttcagataaagctgttcttgaacattttttt

SEQ ID NO: 456 - DNA, 742 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaatggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaattgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaagggaatctttatacttcagataaagctgttcttgaacattttttttagtcattatcttagttaaccgag

SEQ ID NO: 457 - DNA, 730 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaagggaatctttatacttcagataaagctgttcttgaacattttttttgtcattatcttagttaaccgag

SEQ ID NO: 458 - DNA, 708 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattctttggccatggaagcttttcagacagcccttttctaaatagcctggtgggacacatcttgcattcctcaattcttgtgccataccatggatggttagttcatcccggcttttttgtttgtcattggaagttcttttattgattcaattttttatagcgtgttcggaaacgcgtttcagaaataatgaaatacatcttgaatctgaaagttataacttttagcttcattgtcattgaaagttcttttattaattatatttttattgcgtgtttggaatcccatttgagaaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaaatcatggacacattgagaaggatgaatcctgggttccagtatgtgattaactacttcctctatagttattttgattcaattaaatttatttatttaataagttcaagaaaaaggaatctttatacttcagataaagctgttcttgaacattttttttagtca

SEQ ID NO: 459 - DNA, 732 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgcatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatattttattgcgtgtttggaatcccatttgagaaataagaaatcacgtttaaaatgtgaaagttataactattaacttttgactaaacttgaaaaaatcacatttttgatgtggaaccaaatctgattttgagaaccaagttgattttgatggattttgcaggagaattagccacagaactcaccatcaaaatcatggacacattgagaaggattgaatcctgggttccagtatgtgattaactacttcctctatagttattttgattcaattaaatttatttatttaataagttcaagaaaaaaggaatcttatacttcagataaagctgttcttgaacatttttttgtcattatcttagttaaccgag

SEQ ID NO: 460 - DNA, 629 bp, Artificial
  Glycine max FAD3A mutation created with TALEN pair GmFAD3_T01.1
  misc_feature (466): n is a or c or t or g
cactgctttgtatgcctacctcatttcatttggctttagacaacttaaatttgagatctttattatgttttttgcttatatggtaaagtgattcattcttcacattgaatcatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttcattgcgtgtttggaatcccatttgagaaataagaaatcacgtttaaaattgtgaaagttataactattaacttttgactaaatcttgaaaaaactcacntttttgaatgtggaaccaaatctgattttgagaaccaagttgaattttgatggattttgcatggagaattagccacagaactcaccattcaaaagtcatggacacattgagaaggaatgaatcctgggttccagtatgtgattaactacttcctctatagtta

SEQ ID NO: 461 - DNA, 735 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaatcagtccatggaagcttttcagacagcccttttctaaatagcctggtgggacacatcttgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttcgtcattatctagttaaccg

SEQ ID NO: 462 - DNA, 695 bp, Artificial
  Glycine max FAD3A mutation created with TALEN pair GmFAD3_T01.1
cactgctttgttatgcctacctcatttcatttggctttagacaacttaaatttgagatctttcatttggccatggaagcttttcagacagccctttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgattgagaaccaagttgattttgatggattttgcaggagaattagccacatgaactcaccatcaaaatcatggacacattgagaaggatgaatcctgggttccagtatgtgattaactacttcctctatagttatttttgattcaattaaatttatttatttaataagttcaagaaaaaatggaatctttatacttcagataaagctagtcttgaacattttttttgtcattatctagtttaaccgagaag

SEQ ID NO: 463 - DNA, 739 bp, Artificial
  Glycine max FAD3A mutation created with TALEN pair GmFAD3_T01.1
  misc_feature (682): n is a or c or t or g
cactgctttgttatgcctacctcatttcatttggctttagacaacttaaatttgagatctttattatgttttttgcttatatggtaaagtgattcattcttcacattgaattgaaacatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatattttattgcgtgtttggaatcccatttgagaaataagaaatcacgtttaaaaattgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaagggaatcttntacttcagataaagctgttcttgaacattttttttagtcattatcttagtaaccgag

SEQ ID NO: 464 - DNA, 628 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattggttgccggtgctgtgccaggcccacggcttgaccccggagcaggtggtggccatcgccagcaatattggtggcaagcagtggccatggaagcttttcagacagcccttttctaaatagcctggtgggacacatcttgcattcctcaattcttgtgccataccatggatggttagttcatcccggctttttgtttgtcattggaagttcttttattgattcaatttttatagcgtgttcggaaaacgcgtttcagaaaataatgaaatacatcttgaatctgaaagttataacttttagcttcattgtcattgaaagttctttattaattatatttttatgcgtgtttggaatccattgagaaataagaaattcacgtttaaaatgtgaaagttataactattaactttgactaaacttgaaaaaagtcacattttgatgtggaaccaaatctgatttgagaaccaagttgatttgatggattttcgcaggagaattagccacagaactcaccatc

SEQ ID NO: 465 - DNA, 716 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaaattgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaagggaatctttatacttcagataaagctgttcttgaacatttttttt

SEQ ID NO: 466 - DNA, 714 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaccatggaagcttttcagacagcccttttctaaatagcctggtgggacacatcttgcattcctcaattcttgtgccataccatggatggttagttcatcccggcttttttgtttgttcattggaagttcttttattgattcaatttttatagcgtgttcggaaacgcgtttcagaaaataatgaaatacatcttgaatctgaaagttataactttttagcttcattgtcattgaaagttctttttattaattatatttttattgcgtgtttggaatcccatttgagaaataagaaatcacgtttaaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttattattaataagttcaagaaaaaggaatctttatacttcagataaagctgttcttgaacatttttttt

SEQ ID NO: 467 - DNA, 619 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaacagacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaagttataacttttagcttcattgtcattgaaagttcttttattaattatatttttatgcgtgtttggaatcccatttgagaaataagaaatcacgtttaaaatgtgaaagttataactattaacttttgactaaacttgaaaaaaactcacattttgattgtggaaccaaattctgatttgagaaccaagttgattttgatggattttgcaggagaattagccacagaactcaccatcaaaagtcatggacacattgagaaggatgaatcctgggttccagtatgtgattaa

SEQ ID NO: 468 - DNA, 497 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaacacctgctggggggtcaagccgtgggcctggcacagcaccggcaacagccgctggaccgtctccagcgcctgcttgccaccgccattgctggcgatggccaccacctgctgggggggtcaagccgtgggcctggcacagcaccggggccatggaagcttttcagacagcccttttctaaatagcctggtgggacacatcttgcattcctcaaattctttgtgccataccatggatggttagttcatcccggctttttggtttgtcattggaagttcttttattgattcaatttttatagcgtgttcggaacgcgttcagaaataatgaaatacatcttgaatctgaaagttataactttagcttcattgtcattgaaagttc

SEQ ID NO: 469 - DNA, 707 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaaagcttttcagacagcccttttctaaatagcctggtgggacacatctgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatattttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgtttaactacttcctctatagttattttgattcaattaaatttatttatttaataagttcaagaaaaaagggaatctttatacttcagataaagctgttcttgaacatttttttt

SEQ ID NO: 470 - DNA, 649 bp, Artificial
  Glycine max FAD3A mutation created with TALEN pair GmFAD3_T01.1
cactgctttgttatgcctacctcatttcatttggctttagacaacttaaatttgagatctttattatgttttttgccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaaggaatctttatacttcag

SEQ ID NO: 471 - DNA, 730 bp, Artificial
  Glycine max FAD3A mutation created with TALEN pair GmFAD3_T01.1
  misc_feature (648); (674): n is a or c or t or g
cactgctttgttatgcctacctcatttcatttggctttagacaacttaaatttgagatctttattatgttttttgcttatatggtaaagtgattcattcttcacattgaattgaccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttnttaataagtcaagaaaaaggatcttntactcagataaagctgtcttgaacattttttttgtcattatcttagaaccgagaag

SEQ ID NO: 472 - DNA, 715 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatattttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaaggaatctttatacttcagataaagctgttcttgaacatttttttt

SEQ ID NO: 473 - DNA, 731 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaagcttttcagacagcccttttctaaatagcctggtgggacacatctgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatattttattgcgtgtttgggaatcccatttgagaaataagaaatcacgtttaaaaattgtgaaagttataactattaacttttgactaaaacttgaaaaaactcacattttttggatgtggaaccaaatctgatttgagaaccaagttgatttgatggattttgcaggagaattagccacagaactcaccatcaaaatcatggacacattgagaaggatgaatcctgggttccagtatgtgattaactacttcctctatagttatttttggattccaattaaaatttatttatttaataagttcaagaaaaagggaatcttatacttcagataaagctgttcttgaacatttttttagtcattatcttagttaaccgag

SEQ ID NO: 474 - DNA, 706 bp, Artificial
  Glycine max FAD3A mutation created with TALEN pair GmFAD3_T01.1
  misc_feature (139); (145): n is a or c or t or g
cactgctttgttatgcctacctcatttcatttggctttagacaacttaaatttgagatctttattatgttttttgcttatatggtaaagtgattcattcttcacattcccatggaagctttttcagacagccctttttnaaaatngcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatattttattgcgtgtttggaatcccatttgagaaataagaaatcacgtttaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaagggaatctttatacttcagataaagctgttcttgaacattttttt

SEQ ID NO: 475 - DNA, 685 bp, Artificial
  Glycine max FAD3A mutation created with TALEN pair GmFAD3_T01.1
cactgctttgttatgcctacctcatttcatttggctttagacaacttaaatttgagatctttcatttggccatggaagcttttcagacagccctttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgattgagaaccaagttgattttgatggattttgcaggagaattagccacatgaactcaccatcaaaatcatggacacattgagaaggatgaatcctgggttccagtatgtgattaactacttcctctatagttatttttgattcaattaaatttatttatttaataagttcaagaaaaaaatggaatctttatacttcagataaagctgtcttgaacatttttttttgtcattatctagtt

SEQ ID NO: 476 - DNA, 711 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaataagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatattttattgcgtgtttggaatcccatttgagaaataagaaatcacgtttaaaattgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttattattaataagttcaagaaaaaggaatcttatacttcagataaagctgttcttgaacatttttttagtcatatcttag

SEQ ID NO: 477 - DNA, 743 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttctttttattaattatatttttattgcgtgtttggaatcccatttgagaaataagaaatcacgtttaaaaattgtgaaagttataactattaacttttgactaaacttgaaaaaactcacattttttggatgtggaaccaaatctgatttgagaaccaagttgattttgatggattttgccaggagaattagccacagaactcaccatcaaaatcatggacacattgagaaggatgaatcctgggttccagtatgtgattaactacttcctctatagttatttttgattcaattaaatttattattaataagttcaagaaaaagggaatcttatacttcagataaagctgttcttgaacattttttttagtcattatcttagttaaccgag

SEQ ID NO: 478 - DNA, 736 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaatggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttattaataagttcaagaaaaaggaatctttatacttcagataaagctgttcttgaacatttttttgtcattatcttagttaaccgag

SEQ ID NO: 479 - DNA, 678 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaac

SEQ ID NO: 480 - DNA, 735 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaaggaatctttatacttcagataaagctgttcttgaacattttttttgtcattatcttagttaaccgag

SEQ ID NO: 481 - DNA, 738 bp, Artificial
  Glycine max FAD3A mutation created with TALEN pair GmFAD3_T01.1
  misc_feature (681): n is a or c or t or g
cactgctttgttatgcctacctcatttcatttggctttagacaacttaaatttgagatctttattatgttttttgcttatatggtaaagtgattcattcttcacattgaatgtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaattgtgaaagttataactattaacttttgactaaacttgaaaaaactcacatttttgatgtggaaccaaatctgatttgagaaccaagttgattttgatggattttgccaggagaattagccacagaactcaccatcaaaatcatggacacattgagaaggatgaatcctgggttccagtatgtgattaactacttcctctatagttattttggtattcaattaaatttatttattataagtcagaaaaagggaatctttntactcagataaagctgtcttgaacattttttttagtcttatcttagtaaccgagaag

SEQ ID NO: 482 - DNA, 735 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaatgccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgttgatgacccatttgagaaataagaaatcacgtttaaaatgtgaaagttataactattaacttttgactaaacttgaaaaaatcacatttttgatgtggaaccaaatctgatttgagaaccaagtttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaagggaatctttatacttcagataaagctgttcttgaacattttttttgtcattatcttagttaaccgag

SEQ ID NO: 483 - DNA, 716 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaatggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaaattgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttattattaataagttcaagaaaaaggaatctttatacttcagataaagctgttcttgaacattttttt

SEQ ID NO: 484 - DNA, 702 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaatagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatattttattgcgtgtttggaatcccatttgagaaataagaaatcacgtttaaaattgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttattattaataagttcaagaaaaaggaatctttatacttcagataaagctgttcttgaacattttttt

SEQ ID NO: 485 - DNA, 712 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaatggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaaggaatctttatacttcagataaagctgttcttgaacatttttttt

SEQ ID NO: 486 - DNA, 716 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgatggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataactttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgattttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaggaatctttatacttcagataaagctgttcttgaacattttttt

SEQ ID NO: 487 - DNA, 712 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttattaataagttcaagaaaaaaggaatctttatacttcagataaagctgtcttgaacatttttttt

SEQ ID NO: 488 - DNA, 624 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaattgtgaaagttataactattaacttttgactaaacttgaaaaaactcacatttttgatgtggaaccaaatctgatttgagaaccaagttgatttgatggattttgcaggagaattagccacagactcaccatcaaaatcatggacacattgagaaggatgaatcctgggttccagtatgtgattaactacttcctctatagtta

SEQ ID NO: 489 - DNA, 741 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaacaccacctgctccggggtcaagccgtgggcctggcacagcaccggcaacagccgctggaccgtctccagcgcctgcttgccgccatcgtggctggcgatggccaccacctgctccggtggccatggaagcttttcagacagcccttttctaaatagcctggtgggacacatcttgcattcctcaattcttgtgccataccatggatggttagttcatcccggctttttgtttgtcattggaagttcttttattgattcaatttttatagcgtgttcggaaacgcgtttcagaaataatgaaatacatcttgaatctgaaagttataacttttagcttcattgtcattgaaagttcttttattaattatatttttcattgcgtgtttggaatcccatttgagaaataagaatcacgtttaaaatgtgaaagttataactattaactttgactaaacttgaaaaaagtcacatttttgatgtggaaccaaatctgatttgagaaccaagttgattttgatggattttgcaggagaattagccacagaactcaccatcaaaatcatggacacattgagaagggatgaatcctgggttccagtatgtgattaactacttcctctatagtt

SEQ ID NO: 490 - DNA, 715 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgacatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaagggaatctttatacttcagataaagctgttcttgaacatttttttt

SEQ ID NO: 491 - DNA, 691 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatattttattgcgtgtttggaatcccatttgagaaataagaaatcacgtttaaaaattgtgaaagttataactattaacttttgactaaacttgaaaaaactcacatttttgatgtggaaccaaatctgattttgagaaccaagttgattttgatggattttgcaggagaattagccacagaactcaccatcaaaatcatggacacattgagaaggatgaatcctgggttccagtatgtgattaactacttcctctatagttatttttggattcaattaaatttatttattaataagttcaagaaaaagggaatctttatacttcagataaagctg

SEQ ID NO: 492 - DNA, 703 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaaatcatggacacattgagaaggatgaatcctgggttccagtatgtgattaactacttcctctatagttattttgattcaattaaatttatttatttaataagttcaagaaaaaaggaatctttatacttcagataaagctgttcttgaacattttttttgtcatta

SEQ ID NO: 493 - DNA, 733 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatattttattgcgtgtttggaatcccatttgagaaataagaaatcacgtttaaaatgtgaaagttataactattaacttttgactaaacttgaaaaaatcacatttttgatgtggaaccaaatctgattttgagaaccaagttgattttgatggattttgcaggagaattagccacagaactcaccatcaaaatcatggacacattgagaaggatgaatcctgggattccagtatgtgattaactacttcctctatagttattttgattcaattaaatttatttatttaataagttcaagaaaaaaggaatctttatacttcagataaagctgattcttgaacatttttttgtcattatcttagttaaccgagaag

SEQ ID NO: 494 - DNA, 731 bp, Artificial
  Glycine max FAD3A mutation created with TALEN pair GmFAD3_T01.1
  misc_feature (671): n is a or c or t or g
cactgctttgttatgcctacctcatttcatttggctttagacaacttaaatttgagatctttattatgttttttgcttatatggtaaagtgattcattcttcacatatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatattttattgcgtgtttggaatcccatttgagaaataagaaatcacgtttaaaattgtgaaagttataactattaacttttgactaaacttgaaaaaactcacatttttgatgtggaaccaaatctgattttgagaaccaagttgatttgatggattttgcaggagaattagccacagaactcaccatcaaaatcatggacacattgagaaggatgaatcctgggttccagtatgtgattaactacttcctctatagttattttgattcaattaaatttatttattaataagttcaagaaaaaaagggaatctttntacttcagataaagctgttcttgaacattttttttagtcattatcttagtaaccgagaag

SEQ ID NO: 495 - DNA, 729 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaatatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatattttattgcgtgtttggaatcccatttgagaaataagaaatcacgtttaaaatgtgaaagttataactattaacttttgactaaacttgaaaaaatcacatttttgatgtggaaccaaatctgattttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaaggaatctttatacttcagataaagctgttcttgaacattttttttgtcattatcttagttaccgag

SEQ ID NO: 496 - DNA, 732 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgagccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatattttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaatttattattaataagttcaagaaaaaggaatctttatacttcagataaagctgttcttgaacattttttttagtcattatcttagttaaccgag

SEQ ID NO: 497 - DNA, 739 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagtttcaagaaaaaaagggaatctttatacttcagataaagctgttcttgaacattttttttagtcattatcttagttaaccgag

SEQ ID NO: 498 - DNA, 621 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgcatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagtta

SEQ ID NO: 499 - DNA, 797 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaacaatgccgggagcagacaagcccgtcagggcgcgtcagcgggtgttggcgggtgtcggggctggcttaactatgcggcatcagagcagtggccatggaagcttttcagacagcccttttctaaatagcctggtgggacacatcttgcattcctcaattcttgtgccataccatggatggttagttcatcccggctttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaagtgtgaaagttataactattaacttttgactaaacttgaaaaaaactcacatttttgatgtggaaccaaaattctgatttgagaaccaagttgattttgatggattttggcaggagaattagcccacagaactcaccatcaaaattcatggacacattgagaagggatgaaatcctgggttccagtatgtgattaactacttcctctatagttattttttggattcaatttaattttatttattaataagttcaagaaaaacgggaatctttatacttcagataaagc

SEQ ID NO: 500 - DNA, 737 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaaatgtgaaagttataactattaacttttgactaaacttgaaaaaatcacatttttgatgtggaaccaaatctgattttgagaaccaagttgattttgatggattttgcaggagaattagccacagaactcaccatcaaaaatcatggacacattgagaaggatgaatcctgggttccagtatgtgattaactacttcctctatagttatttttgattcaattaaatttatttatttaataagttcaagaaaaaaggaatctttatacttcagataaagctgttcttgaacattttttttgtcattatcttagtaaccg

SEQ ID NO: 501 - DNA, 798 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaaccggaccactgtttgccgacgccaacgatcgcttcgtgtgtcgcctctggcaacgctgcgatcatgtcctggttgtagccgccggagtaggccttggtgtccacgatcacgccgtagtcgatgggggagcccacggtgtagatggcgccgtcgggcttcagtggccatggaagcttttcagacagcccttttctaaaatagcctggtgggacacatcttgcattcctcaattcttgtgccataccatggatggttagttcatcccggctttttgtttgtcattggaagttcttttattgattcaatttttatagcgtgttcggaaacgcgtttcagaaaattaatgaaatacatcttgaatctgaaagttataacttttagcttcattgtcattgaaagttcttttattaattatattttattgcgtgtttggaatcccatttgagaaataagaaatcacgtttaaaatgtgaaagttataactattaactttgactaaacttgaaaaatcacatttttgatgtggaaccaaatctgatttgagaaccaagttgattttgatggattttgcaggagaattagccacagaactcaccatcaaatcatggacacattgagaaggatgaatcctgggttccagtatgtgattaactacttcctctatagttattttttgattcaa

SEQ ID NO: 502 - DNA, 729 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatattttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgatttgatggattttgcaggagaattagccacagaactcaccatcaaaatcatggacacattgagaggatgaatcctgggttccagtatgtgattaactacttcctctatagttattttgattcaattaaatttatttattaataagttcaagaaaaaggaatcttatacttcagataaagctgttcttgaacatttttttgtcattatcttagttaaccgag

SEQ ID NO: 503 - DNA, 687 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattcatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatattttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaagggaatctttatacttcagataaagctg

SEQ ID NO: 504 - DNA, 713 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgatggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttattattaataagttcaagaaaaaggaatctttatacttcagataaagctgttcttgaacatttttttt

SEQ ID NO: 505 - DNA, 785 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaatgacagcgacggtccctaacgctgccgggtgttggcttaacgcaacgatgtgcgcgtgtgtaaacccgtggccgaccagtgcctcgtggtgccatggaagcttttcagacagccctttttctaaatagcctggtgggacacatcttgcattcctcaattcttgtgccataccatggatggttagttcatcccggctttttgtttgtcattggaagttctttttattgattcaatttttatagcgtgttcggaaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaattcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaattttatttatttaataagttcaagaaaaacggaatctttatacttcagat

SEQ ID NO: 506 - DNA, 726 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaaatcatggacacattgagaaggatgaatcctgggttccagtatgtgattaactacttcctctatagttattttgattcaattaaatttatttatttaataagttcaagaaaaaaaggaatctttatacttcagataaagctgttcttgaacatttttttgtcattatcttagttaaccgag

SEQ ID NO: 507 - DNA, 736 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaggccatggaagcttttcagacagcccttttctaaatagcctggtgggacacatcttgcattcctcaattcttgtgccataccatggatggttagttcatcccggcttttttgtttgtcattggaagttcttttattgattcaattttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaattgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttattattaataagttcaagaaaaaggaatcttatacttcagataaagctgttcttgaacattttttttagtcattatcttagttaaccgag

SEQ ID NO: 508 - DNA, 627 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttctttttattaattatatttttattgcgtgtttggaatcccatttgagaaataagaaatcacgtttaaaattgtgaaagttataactattaacttttgactaaacttgaaaaaactcacatttttgatgtggaaccaaatctgatttgagaaccaagttgatttgatggattttgcaggagaattagccacagaactcaccatcaaaatcatggacacattgagaaggatgaatcctgggttccagtatgtgattaactacttcctctatagtta

SEQ ID NO: 509 - DNA, 742 bp, Artificial
  Glycine max FAD3A mutation created with TALEN pair GmFAD3_T01.1
cactgctttgttatgcctacctcatttcatttggctttagacaacttaaatttgagatctttattatgtttttttgcttatatggtaaagtgattcattcttcacattgaattgaaccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaaattgtgaaagttataactattaacttttgactaaacttgaaaaaatcacatttttgatgtggaaccaaatctgatttgagaaccaagttgattttgatggattttgcaggagaattagccacagaactcaccatcaaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacattttttttagtcattatcttagttaaccgag

SEQ ID NO: 510 - DNA, 731 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttattattaataagttcaagaaaaaggaatctttatacttcagataaagctgttcttgaacatttttttgtcattatcttagttaaccgag

SEQ ID NO: 511 - DNA, 735 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaacagcaccggcaacagcgcctgcaccgtctccagcgcctgcttgccaccaatattgctggcgatggccaccacctgctccggggtcaagccgtgggcctggcacagcaccggcaacagtggccatggaagcttttcagacagcccttttctaaatagcctggtgggacacatcttgcattcctcaattcttgtgccataccatggatggttagttcatcccggctttttgtttgtcattggaagttcttttattgattcaatttttatagcgtgttcggaaacgcgtttcagaaataatgaaatacatcttgaatctgaaagttataacttttagcttcattgtcattgaaagttcttttattaattatatttttattgcgtgtttggaatccccatttgagaaataagaaatcacgtttaaaatgtgaaagttatactattaactttgactaaacttgaaaaaatcacatttttgatgtggaaccaaatctgatttgagaaccagttgattttgatggattttgcaggagaattagccacagaacttcaccattcaaaattcatggacatcattgagaaggatgaatcctgggttccagtatgtgattaactacttcctc

SEQ ID NO: 512 - DNA, 709 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttattattaatagttcaagaaaaaggaatctttatacttcagataaagctgttcttgaacatttttttt

SEQ ID NO: 513 - DNA, 745 bp, Artificial
  Glycine max FAD3A mutation created with TALEN pair GmFAD3_T01.1
cactgctttgttatgcctacctcatttcatttggctttagacaacttaaatttgagatctttattatgtttttttgcttatatggtaaagtgattcattcttcacattgaattggccatggaagcttttcagacagcccttttctaaatagcctggtgggacacatcttgcattcctcaattcttgtgccataccatggatggttagttcatcccggctttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaaattgtgaaagttataactattaacttttgactaaacttgaaaaaactcacattttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaagggaatctttatacttcagataaagctgttcttgaacattttttttagtcattatcttagttaaccgag

SEQ ID NO: 514 - DNA, 808 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaacaccacctgctccggggtcaagccgtgggcctggcacagcaccggcaacagccgctggaccgtctccagcgcctgcttggccatggaagcttttcagacagcccttttctaaatagcctggtgggacacatcttgcattcctcaattcttgtgccataccatggatggttagttcatcccggcttttttgtttgtcattggaagttctttttattgattcaatttttatagcgtgttcggaaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtaatgtgattaactacttcctctatagttatttttgattcaattaaatttatttatttaataagttcaagaaaaaggaatctttatactttcagattaaagctgttcttgaacatttttttgtcattatctt

SEQ ID NO: 515 - DNA, 740 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgcatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatattttattgcgtgtttggaatcccatttgagaataagaaatcacgtttaaaatgtgaaagttataactattaacttttgactaaacttgaaaaaatcacattttgatgtggaaccaaatctgattttgagaaccaagttgattttgatggattttgcatggagaattagccacagaactcaccatcaaaatcatggacacattgagaaggattgaatcctgggttccagtatgtgattaactacttcctctatagttattttgattcaattaaatttattttatttaattaagttcaagaaaaaaagggaatctttatacttcagataaagctgttcttgaacatttttttgtcattatcttagttaaccgagaag

SEQ ID NO: 516 - DNA, 745 bp, Artificial
  Glycine max FAD3A mutation created with TALEN pair GmFAD3_T01.1
  misc_feature (684): n is a or c or t or g
cactgctttgttatgcctacctcatttcatttggctttagacaacttaaatttgagatctttattatgttttttgcttatatggtaaagtgattcattcttcacattgaattgggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaaattatattttattgcgtgtttggaatcccatttgagaaataagaaatcacgtttaaaatgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttggattcaattaaatttatttatttaataagttcaagaaaaaagggaatctttntacttcagataaagctgttcttgaacattttttttagtcattatcttagttaaccgagaag

SEQ ID NO: 517 - DNA, 659 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaacaggcgctggagacggtgcaggcgctgttgccggtgctgtgccaggcccacggcttgaccccggagcaggtggtggccatcgccagcagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaatcacatttttgatgtggaaccaaatctgatttgagaaccaagttgattttgatggattttgcaggagaattagccacagaactcaccatcaaaatcatggacac

SEQ ID NO: 518 - DNA, 737 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgagccccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttattaataagttcaagaaaaaaggaatctttatacttcagataaagctgttcttgaacatttttttgtcattatcttagttaaccgag

SEQ ID NO: 519 - DNA, 622 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatattttattgcgtgtttggaatcccatttgagaataagaaatcacgtttaaaattgtgaaagttataactattaacttttgactaaacttgaaaaaactcacatttttgatgtggaaccaaatctgatttgagaaccaagttgattttgatggattttgcaggagaattagccacagactcaccatcaaaatcatggacacattgagaaggatgaatcctgggttccagtatgtgattaactacttcctctatagtta

SEQ ID NO: 520 - DNA, 734 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaaccatggaagcttttcagacagcccttttctaaatagcctggtgggacacatcttgcattcctcaattcttgtgccataccatggatggttagttcatcccggcttttttgtttgtcattggaagttcttttattgattcaattttatagcgtgttcggaaacgcgtttcagaaaataatgaaatacatcttgaatctgaaagttataacttttagcttcattgtcattgaaagttctttttatttaaattatatttttattgcgtgtttggaatcccatttgagaaataagaaatcacgtttaaaaattgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaagggaatctttatacttcagataaagctgttcttgaacattttttttagtcattatcttag

SEQ ID NO: 521 - DNA, 730 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaataagaaatcacgtttaaaatgtgaaagttataactattaacttttgactaaacttgaaaaaatcacatttttgatgtggaaccaaatctgattttgagaaccaagttgattttgatggattttgcaggagaattagccacagaactcaccatcaaaatcatggacacattgagaaggatgaatcctgggttccagtatgtgattaactacttcctctatagttattttgattcaattaaatttattattaataagttcaagaaaaaggaatcttatacttcagataaagctgttcttgaacatttttttgtcattatcttagttaaccgag

SEQ ID NO: 522 - DNA, 578 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgatggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatattttattgcgtgtttggaatccatttgagaaataagaaatcacgtttaaaatgtgaaagttataactattaacttttgactaaacttgaaaaaatcacattttgatgtggaaccaaatctgatttgagaaccaagttgaattttgatggattttgcatggagaattagccacagaactcaccatcaaaatcatggacacattgagaagga

SEQ ID NO: 523 - DNA, 718 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacatggaagctttttcagacagccctttttctaaatagcctggtggggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaaatcatggacacattgagaaggatgaatcctgggttccagtatgtgattaactacttcctctatagttattttgattcaattaaatttatttatttaataagttcaagaaaaaaaggaatctttatacttcagataaagctgttcttgaacattttttttgtcattatcttag

SEQ ID NO: 524 - DNA, 628 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaattgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggattgaatcctgggttccagtatgtgattaactacttcctctatagtta

SEQ ID NO: 525 - DNA, 720 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgcttcatttgttatccatggaagcttttcagacagcccttttctaaatagcctggtgggacacatcttgcattcctcaattcttgtgccataccatggatggttagttcatcccggcttttttgtttgtcattgggaagttcttttattgattcaattttttatagcgtgttcggaaacgcgtttcagaaataatgaaatacatcttgaatctgaaagttataacttttagcttcattgtcattgaaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaggaatctttatacttcagataaagctgttcttgaacatttttttgtcattatcttagttaacc

SEQ ID NO: 526 - DNA, 712 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattcatggaagcttttcagacagcccttttctaaatagcctggtgggacacatcttgcattcctcaattcttgtgccataccatggatggttagttcatcccggcttttttgtttgtcattggaagttcttttattgattcaattttatagcgtgttcggaaacgcgtttcagaaaataatgaaatacatcttgaatctgaaagttataacttttagcttcatttgtcattgaaagttctttttattaaattatatttttattgcgtgtttggaatcccatttgagaaataagaaatcacgtttaaaattgtgaaagttataactattaacttttgactaaacttgaaaaaatcacatttttgatgtggaaccaaatctgatttgagaaccaagttgattttgatggattttgcagagaattagccacagaactcaccatcaaaatcatggacacattgagaaggatgaatcctgggttccagtatgtgattaactacttcctctatagttatttttgattcaattaaatttatttatttaataagttcaagaaaaaaggaatctttatacttcagataaagctgttcttgaacatttttttt

SEQ ID NO: 527 - DNA, 667 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaataatgaaatacatcttgaatctgaaagttataacttttagcttcattgtcattgaaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaaatcatggacacattgagaaggatgaatcctgggttccagtatgtgattaactacttcctctatagttatttttgattcaattaaatttatttatttaataagttcaagaaaaaggaatctttatacttcagataaagctg

SEQ ID NO: 528 - DNA, 623 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagtta

SEQ ID NO: 529 - DNA, 727 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttattaataagttcaagaaaaaggaatcttatacttcagataaagctgattcttgaacatttttttgtcattatcttag

SEQ ID NO: 530 - DNA, 636 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaactggcgatggccaccacctgctccggggtcaagccgtgggcctggcggccatggaagcttttcagacagcccttttctaaatagcctggtgggacacatcttgcattcctcaattcttgtgccataccatggatggttagttcatcccggctttttgtttgtcattggaagttcttttattgattcaatttttatagcgtgttcggaaaacgcgtttcagaaaataatgaaaatacatcttgaatctgaaaagttaataacttttagcttcattgtcattgaaagttcttttattaattatatttttattgcgtgtttggaatcccatttgagaaataatgaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcct

SEQ ID NO: 531 - DNA, 719 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaatcagtccatggaagcttttcagacagcccttttctaaatagcctggtgggacacatcttgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacattttttttcgtca

SEQ ID NO: 532 - DNA, 507 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaatgctggggggtcaagccgtgggcctggcacagcaccggcaacagccgctggaccgtctccagcggccatggaagctttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaatgtgaaagttataactattaac

SEQ ID NO: 533 - DNA, 718 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataactttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaagggaatctttatacttcagataaagctgttcttgaacatttttttt

SEQ ID NO: 534 - DNA, 727 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatattttattgcgtgtttggaatcccatttgagaaataagaaatcacgtttaaaatgtgaaagttataactattaacttttgactaaacttgaaaaaactcacatttttgatgtggaaccaaatctgattttgagaaccaagttgattttgatggattttgcaggagaattagccacagaactcaccatcaaaatcatggacacattgagaaggatgaatcctgggttccagtatgtgattaactacttcctctatagttattttgattcattaatttattattaataagttcaagaaaaaggaatctttatacttcagataaagctgttcttgaacattttttttagtcattatcttagttaaccgag

SEQ ID NO: 535 - DNA, 733 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaatggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatattttattgcgtgtttggaatcccatttgagaaataagaaatcacgtttaaaattgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaagggaatctttatacttcagataaagctgttcttgaacattttttttagtcattatcttag

SEQ ID NO: 536 - DNA, 738 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgacatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaaattgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaggaatctttatacttcagataaagctgttctttgaacattttttttagtcattatcttagttaaccgag

SEQ ID NO: 537 - DNA, 621 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgacatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatattttattgcgtgtttggaatcccatttgagaaataagaaatcacgtttaaaaattgtgaaagttataactattaacttttgactaaacttgaaaaaactcacatttttgatgtggaaccaaatctgatttgagaaccaagttgatttgatggattttgcaggagaattagccacagaactcaccatcaaaatcatggacacattgagaaggatgaatcctgggttccagtatgtgattaactacttcctctatag

SEQ ID NO: 538 - DNA, 713 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaccatggaagcttttcagacagcccttttctaaatagcctggtgggacacatcttgcattcctcaattcttgtgccataccatggatggttagttcatcccggcttttttgtttgtcattggaagttcttttattgattcaattttatagcgtgttcggaaacgcgttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacatgagaaggatgaatcctgggttccagtatgtgattaactacttcctctatagttattttgattcaattaaatttatttatttaataagttcaagaaaaaaagggaatctttatacttcagataaagctgttcttgaacatttttttt

SEQ ID NO: 539 - DNA, 712 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgattttgagaaccaagttgattttgatggattttgcaggagaattagccacagaactcaccatcaaaatcatggacacattgagaaggatgaatcctgggttccagtatgtgattaactacttcctctatagttattttgattcaattaaatttattattaataagttcaagaaaaaggaatctttatacttcagataaagctgttcttgaacatttttttt

SEQ ID NO: 540 - DNA, 610 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgatggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgatttgatggattttgcaggagaattagccacagaactcaccattcaaaatcatggacacattgaggaaggattgaatcctgggttccagtatgtgattaac

SEQ ID NO: 541 - DNA, 724 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaatggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttattaataagttcaagaaaaaaggaatctttatacttcagataaagctgttcttgaacatttttttgtcattatcttag

SEQ ID NO: 542 - DNA, 624 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaccatggaagcttttcagacagcccttttctaaatagcctggtgggacacatcttgcattcctcaattcttgtgccataccatggatggttagttcatcccggctttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagtttgattttgatggattttgcaggagaattagccacagaactcaccatcaaaatcatggacacattgagaaggatgaatcctgggttccagtatgtgattaactacttcctctatagtta

SEQ ID NO: 543 - DNA, 738 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgatttgatggattttgcaggagaattagccacagaactcaccatcaaaatcatggacacattgagaaggattgaatcctgggttccagtatgtgattaactacttcctctatagttatttttgattcaattaaatttatttatttaataagttcaagaaaaaaggaatctttatacttcagataaagctgttcttgaacatttttttgtcattatcttagttaaccgag

SEQ ID NO: 544 - DNA, 650 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgatggaagcttttcagacagcccttttctaaatagcctggtgggacacatcttgcattcctcaattcttgtgccataccatggatggttagttcatcccggctttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatattttattgcgtgtttggaatcccatttgagaaataagaaatcacgtttaaaattgtgaaagttataactattaacttttgactaaactgaaaaaactcacatttttgatgtggaaccaaatctgatttgagaaccaagttgatttgatggattttgcaggagaattagccacagaactcaccatcaaaatcatggacacattgagaaggatgaatcctgggtccagtatgtgattaactacttcctcctatagttatttttggtattcaattaaatttatttatttaat

SEQ ID NO: 545 - DNA, 725 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacatcatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatattttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaaggaatctttatacttcagataaagctgattcttgaacatttttttgtcattatcttagttaaccgag

SEQ ID NO: 546 - DNA, 735 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaaaggaatctttatacttcagataaagctgattcttgaacattttttttgtcattatcttagttaaccgag

SEQ ID NO: 547 - DNA, 590 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcatttgtcattgaaaagttcttttattaattatatttttattgcgtgtttggaatcccatttgagaaattaagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccattcaaaatcatggacacattgagaaggatgaatcctggg

SEQ ID NO: 548 - DNA, 720 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaacacatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaaattgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaagggaatctttatacttcagataaagctgttcttgaacattttttttt

SEQ ID NO: 549 - DNA, 626 bp, Artificial
  Glycine max FAD3A mutation created with TALEN pair GmFAD3_T01.1
  misc_feature (393): n is a or c or t or g
cactgctttgttatgcctacctcatttcatttggctttagacaacttaaatttgagatctttattatgttttttgcttatatggtaaagtgattcattcttcacattggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttatttaattatatttttatttgcggtttggaatcccatttgngaaataagaaatcacgtttaaaattgtgaaagttataactattaacttttgactaaacttgaaaaaactcacattttttgatgtggaacccaaaatctgattttgagaaccaagttgattttgatggattttgcaggagaattagccacagaactcaccatcaaaatcatggacacattgagaaggatgaatcctgggttccagtatgtgattaactacttcctctatagtta

SEQ ID NO: 550 - DNA, 726 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgcttcatttgttatccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaataatgaaatacatcttgaatctgaaagttataacttttagcttcattgtcattgaaaagttcttttattaattatatttttattgcgtgtttggaatcccatttgagaaataagaaatcacgtttaaaatgtgaagttataactattaacttttgactaaacttgaaaaaatcacattttgatgtggaaccaaatctgatttgagaaccaagttgattttgatggattttgcaggagaattagccacagaactcaccatcaaaaatcatggacacattgagaaggatgaatcctgggttccagtatgtgattaactacttcctctatagttatttttgattcaattaaaatttatttatttaataagttcaagaaaaaggaatctttatacttcagataaagctgttcttgaacattttttttgtcattatcttagttaaccgagaa

SEQ ID NO: 551 - DNA, 744 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgatccctttttcactgcatccagcgcaggacgcccgccgaggcaggccaaggcgacgaggtggtcgttggtcaacgcggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaagtcacatttttgatgtggaaccaaatctgatttgagaaccaagttgattttgatggattttgcaggagaatttagccacagaactcaccatcaaaatcatggacacattgagaaggatgaatcctgggttccagtatgtgattaactacttccctctatagttatttttcgattcaattaaatttatttatttaataagttcaa

SEQ ID NO: 552 - DNA, 737 bp, Artificial
  Glycine max FAD3A mutation created with TALEN pair GmFAD3_T01.1
cactgctttgttatgcctacctcatttcatttggctttagacaacttaaatttgagatctttattatgtttttttgcttatatggtaaagtgattcattcttcacattgaattggaagttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttctttttattaaattatatttttattgcgtgtttggaatcccatttgagaaataagaaatcacgtttaaaaattgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaagggaatctttatacttcagataaagctgttcttgaacattttttttagtcattatcttagttaaccgag

SEQ ID NO: 553 - DNA, 746 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaacagacagtggccatggaagcttttcagacagcccttttctaaatagcctggtgggacacatcttgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttcgtcattatctagttaaccg

SEQ ID NO: 554 - DNA, 630 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaccatggaagcttttcagacagcccttttctaaaatagcctggtgggacacatcttgcattcctcaattcttgtgccataccatggatggttagttcatcccggcttttttgtttgtcattggaagttcttttattgattcaattttatagcgtgttcggaaacgcgtttcagaaaataatgaaatacatcttgaatctgaaagttataacttttagcttcatgtcattgaaagttctttttattaattatatttttattgcgtgttttggaaatcccatttgagaaataagaaatcacgtttaaaaattgtgaaagttataactattaactttttgactaaacttgaaaaaactcacattttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagtta

SEQ ID NO: 555 - DNA, 728 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatattttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgaattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaaggaatctttatacttcagataaagctgttcttgaacatttttttgtcattatcttagttaaccgag

SEQ ID NO: 556 - DNA, 737 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgagccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgattttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaaaggaatctttatacttcagataaagctgttcttgaacatttttttgtcattatcttagttaaccgag

SEQ ID NO: 557 - DNA, 731 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatattttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgatttgatggattttgcaggagaattagccacagaactcaccattcaaaatcatggacacattgagaaggattgaatcctgggttccagtatgtgattaactacttcctctatagttattttgattcaattaaatttatttattaataagttcaagaaaaaaggaatcttatacttcagataaagctgttcttgaacattttttttgtcattatcttagtaaccgag

SEQ ID NO: 558 - DNA, 728 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacatcatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttatttaattatatttttattgcggtttggaatcccatttgagaaataagaaatcacgtttaaaattgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttattaataagttcaagaaaaagggaatctttatacttcagataaagctgttcttgaacattttttttagtcattatcttagttaaccgag

SEQ ID NO: 559 - DNA, 735 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataactttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttattaataagttcaagaaaaaaggaatcttatacttcagataaagctgttcttgaacattttttttgtcattatcttagttaaccgag

SEQ ID NO: 560 - DNA, 723 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgatcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatattttattgcgtgtttggaatcccatttgagaaataagaaatcacgtttaaaattgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttattaataagttcaagaaaaagggaatcttatacttcagataaagctgttcttgaacatttttttagtcattatcttagttaaccgag

SEQ ID NO: 561 - DNA, 736 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttattaataagttcaagaaaaagggaatctttatacttcagataaagctgttcttgaacattttttttagtcattatcttagttaaccgag

SEQ ID NO: 562 - DNA, 728 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgcatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttattaataagttcaagaaaaaggaatcttatacttcagataaagctgttcttgaacatttttttgtcattatcttagttaaccga

SEQ ID NO: 563 - DNA, 657 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatttcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttcttttattaattatatttttattgcgtgtttggaatccatttgagaaataagaaatcacgtttaaaatgtgaaagttataactattaacttttgactaaacttgaaaaaatcacatttttgatgtggaaccaaatctgatttgagaaccaagttgattttgatggatttttgcaggagaattagccacagaactcaccatcaaaaatcatggacacattgagaaggatgaatcctgggttccagtatgtgattaactacttcctctatagttattttgattcaattaaatttatttatttaataagttcaagaaaaaaggaatctttatacttcagataaagctg

SEQ ID NO: 564 - DNA, 752 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattccagcggctgttgccaccattattgctggcgatggccaccacctgctggggggtcagtggccatggaagcttttcagacagcccttttctaaatagcctggtgggacacatcttgcattcctcaattcttgtgccataccatggatggttagttcatcccggctttttgtttgtcattggaagttcttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgatttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaagggaatctttatacttcagataaagctg

SEQ ID NO: 565 - DNA, 687 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtatggaagcttttcagacagcccttttctaaatagcctggtgggacacatcttgcattcctcaattcttgtgccataccatggatggttagttcatcccggcttttttgtttgtcattggaagttcttttattgattcaattttttatagcgtgttcggaaaacgcgtttcagaaataatgaaatacatcttgaatctgaaagttataacttttagcttcattgtcattgaaaagttcttttattaattatatttttaattgcgtgtttggaatcccatttgagaaatagaaatcacgtttaaattgtgaagttataactattaacttttgactaaacttgaaaaaatcacattttgatgtggaaccaaatctgatttgagaaccaagttgattttgatggattttgcaggagaattagccacagaactcaccatcaaaaatcatggacacattgagaaggatgaatcctgggttccagtatgtgattaactacttcctctatagttattttgattcaattaaatttatttatttaataagttcaagaaaaagggaatctttatacttcagataaagctgttcttgaacattttttttagtca

SEQ ID NO: 566 - DNA, 733 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttattattaataagttcaagaaaaaggaatcttatacttcagataaagctgttcttgaacatttttttagtcattatcttagttaaccgag

SEQ ID NO: 567 - DNA, 709 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaatggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttattaataagttcaagaaaaaggaatcttatacttcagataaagctgttcttgaacattttttt

SEQ ID NO: 568 - DNA, 740 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataactttttagcttcattgtcattgaaagttcttttattaattatattttattgcgtgtttggaatcccatttgagaaataagaaatcacgtttaaaaatgtgaaagttataactattaacttttgactaaacttgaaaaaatcacatttttgatgtggaaccaaatctgatttgagaaccaagttgattttgatggattttgcaggagaattagccacagaactcaccatcaaaaatcatggacacattgagaaggatgaatcctgggttccagtatgtgattaactacttcctctatagttatttttgattcaattaaatttatttatttaataagttcaagaaaaaaggaatcttatacttcagataaagctgttcttgaacatttttttagtcattatcttagttaaccgagaag

SEQ ID NO: 569 - DNA, 623 bp, Artificial; identical to SEQ ID NO: 528
  Glycine max FAD3A mutation created with TALEN pair GmFAD3_T01.1

SEQ ID NO: 570 - DNA, 626 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttt

SEQ ID NO: 571 - DNA, 734 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgattttgagaaccaagttgaattttgatggattttgcaggagaattagccacagaactcaccatcaaaaatcatggacacattgagaaggatgaatcctgggttccagtatgtgattaactacttcctctatagttatttttgattcaattaaatttatttatttaataagttcaagaaaaaaggaatctttatacttcagataaagctgattcttgaacatttttttgtcattatcttagttaaccgagaag

SEQ ID NO: 572 - DNA, 819 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaacgtgggcctggcacagcaccggcaacagccgctggaccgtctccagcgcctgcttgccaccgccattgctggcgatggccaccacctgctggggggtcaagccgtgggatactgttcttctagtgtagccgtagttaggccaccacttcaagaactctgtagcaccgcctacatacctcgctctgctaatcctgttaccagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgttcagaaaataatgaaatactcttgaatctgaaagttataacttttagcttcattgtcattgaaagttcttttattaattatattttattgcgtgtttggaatcccatttgagaaataagaaatcacgtttaaaatgtgaaagttataactattaactttgactaaacttgaaaaatcaacatttttgatgtggaaccaaatctgattttgagaaccaagttgatttttgatggatttttgcaggtagaaattagccacagaacttcaccatcaaaaattcatgggatcacattgagaaggatgaatcctgggttccagtatgtgattaactac

SEQ ID NO: 573 - DNA, 824 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaatcaccggcaacagccgctggaccgtctccagcgcctgcttgccgccatcgtggctggcgatggccaccacctgctccggggtcaatggccatggaagcttttcagacagcccttttctaaatagcctggtgggacacatcttgcattcctcaattcttgtgccataccatggatggttagttcatcccggctttttgtttgtcattggaagttctttttattgattcaatttttatagcgtgttcggaaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaattcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaattttatttatttaataagttcaagaaaaacggaatctttatacttcagataaagctgttcttgaacatttttttgtcattatcttagttaaccgagaag

SEQ ID NO: 574 - DNA, 698 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaataatgaaatacatcttgaatctgaaagttataacttttagcttcattgtcattgaaagttcttttataattatatttttattgcgtgtttggaatcccatttgagaaataagaaatcacgtttaaaatgtgaaagttataactattaactttgactaaacttgaaaaaatcacattttgatgtggaaccaaatctgatttgagaaccaagttgattttgatggattttgcaggagaattagccacagaactcaccatcaaaaatcatggacacattgagaaggatgaatcctgggttccagtatgtgattaactacttcctctatagttattttgattcaattaaaatttatttatttaataagttcaagaaaaaaggaatctttatacttcagataaagctgttcttgaacattttttttgtcatta

SEQ ID NO: 575 - DNA, 803 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattcagcggctgttgccggtgctgtgccaggcccacggcttgaccccggagcaggtggtggccatcgccagcggccatggaagcttttcagacagccctttttctaaatagcctggtgggacacatcttgcattcctcaattcttgtgccataccatggatggttagttcatcccggcttttttgtttgtcattggaagttcttttattgattcaattttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaagggaatctttatacttcagataaagctgttctttgaacattttttttgtcattattctagtttaaccga

SEQ ID NO: 576 - DNA, 741 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgagccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaaattgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttattatttaataagttcaagaaaaaagggaatctttatacttcagataaagctgttcttgaacattttttttagtcattatcttagttaaccgag

SEQ ID NO: 577 - DNA, 722 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatattttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaagggaatctttatacttcagataaagctgttcttgaacattttttttagtcattatcttag

SEQ ID NO: 578 - DNA, 627 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcatttgtcattgaaagttctttttattaattatatttttattgcgtgtttggaatcccatttgagaaataagaaatcacgtttaaaaatgtgaaagttataactattaacttttgactaaacttgaaaaaatcacatttttgatgtggaaccaaatctgatttgagaaccaagttgattttgatggattttgcaggagaattagccacagaactcaccatcaaaaatcatggacacattgagaaggatgaatcctgggttccagtatgtgattaactacttcctctatagtta

SEQ ID NO: 579 - DNA, 735 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgattttgagaaccaagttgattttgatggattttgcaggagaattagccacagaactcaccatcaaaatcatggacacattgagaaggatgaatcctgggttccagtatgtgattaactacttcctctatagttattttgattcaattaaatttattattaataagttcaagaaaaaaggaatctttatacttcagataaagctgttcttgaacatttttttgtcattatcttagttaaccgag

SEQ ID NO: 580 - DNA, 696 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacatggaagctttttcagacagcccttttctaaatagcctggtggggacacatcttgcattcctcaattcttgtgccataccatggatggttagttcatcccggctttttttgtttgtcattggaagttcttttattgattcaatttttatagcgtgttcggaaacgcgtttcagaaaataatgaaatacatcttgaatctgaaagttataacttttagcttcattgtcattgaaagttctttttatttaattatatttttattgcgtgtttggaatcccatttgagaaataagaaatcacgtttaaaaattgtgaaagttataactattaactttttgactaaactttgaaaaaatcacatttttgatgtggaaccaaatctgatttgagaaccaagttgattttgatggattttgcaggagaattagccacagaactcaccatcaaaatcatggacacattgagaaggatgaatccttgggttccagtatgtgattaactacttcctctatagttattttgattcaattaaatttatttatttaataagttcaagaaaaaagggaatctttatacttcagataaagctgttc

SEQ ID NO: 581 - DNA, 735 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaatggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaaggaatctttatacttcagataaagctgttcttgaacattttttttgtcattatcttagttaaccgag

SEQ ID NO: 582 - DNA, 609 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaatggggggtcaagccgtgggcctggcacagcaccggcaacagccgctggaccgtctccagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatattttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgatttgatgggattttgcaggagaattagccacagaactcaccatc

SEQ ID NO: 583 - DNA, 751 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacaagatctttattatgttttttgcttatatggccatggaagcttttcagacagcccttttctaaatagcctggtgggacacatcttgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaattttatttatttaataagttcaagaaaaatggaatctttatacttcagataaagcttgttctgaacattttttttgtcattatctaagtt

SEQ ID NO: 584 - DNA, 737 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaatgtggccatggaagcttttcagacagcccttttctaaatagcctggtgggacacatcttgcattcctcaattcttgtgccataccatggatggttagttcatcccggctttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaaggaatcttatacttcagataaagctgattcttgaacatttttttgtcattatcttagttaaccgag

SEQ ID NO: 585 - DNA, 718 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaatcatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttattattaataagttcaagaaaaaggaatctttatacttcagataaagctgttcttgaacatttttttgtcattatcttag

SEQ ID NO: 586 - DNA, 701 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaaatgtgaaagttataactattaacttttgactaaacttgaaaaaatcacatttttgatgtggaaccaaatctgatttgagaaccaagttgattttgatggattttgcaggagaattagccacagaactcaccatcaaaaatcatggacacattgagaaggatgaatcctgggttccagtatgtgattaactacttcctctatagttattttgattcaattaaatttatttattaataagttcaagaaaaaaggaatctttatacttcagataaagctgttcttg

SEQ ID NO: 587 - DNA, 737 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgcatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaaattgtgaaagttataactattaacttttgactaaacttgaaaaaactcacatttttgatgtggaaccaaatctgattttgagaaccaagttgattttgatggattttgcaggagaattagccacagaactcaccatcaaaatcatggacacattgagaaggatgaatcctgggttccagtatgtgattaactacttcctctatagttattttgattcaattaaatttattattaataagttcaagaaaaaggaatctttatacttcagataaagctgttcttgaacatttttttagtcattatcttagttaaccgagaag

SEQ ID NO: 588 - DNA, 707 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaatcagtccatggaagcttttcagacagcccttttctaaatagcctggtgggacacatcttgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagtttcaagaaaaatggaatctttatacttcagataaagctgttcttgaac

SEQ ID NO: 589 - DNA, 708 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacatcatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaaagggaatctttatacttcagataaagctgttcttgaacatttttttt

SEQ ID NO: 590 - DNA, 713 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaatggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaaggaatctttatacttcagataaagctgttcttgaacatttttttt

SEQ ID NO: 591 - DNA, 734 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgagccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatattttattgcgtgtttggaatcccatttgagaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaagggaatcttatacttcagataaagctgttcttgaacatttttttagtcattatcttagttaaccgag

SEQ ID NO: 592 - DNA, 713 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaagccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttattaataagttcaagaaaaaggaatcttatacttcagataaagctgttcttgaacatttttttt

SEQ ID NO: 593 - DNA, 692 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaatttggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaataagaaatcacgtttaaaatgtgaaagttataactattaacttttgactaaacttgaaaaaatcacatttttgatgtggaaccaaatctgatttgagaaccaagttgattttgatggattttgcaggaaaattagccacagaactcaccatcaaaatcatggacacattgagaaggatgaatcctgggttccagtatgtgattaactacttcctctatagttatttttgattcaattaaatttatttattaatagttcaagaaaaaggaatctttatacttcagataaagc

SEQ ID NO: 594 - DNA, 663 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaatgaggtaggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaaatttatttatttaaataagttcaagaaaaaaggaatctttatacttcagataaagctg

SEQ ID NO: 595 - DNA, 617 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatattttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagtta

SEQ ID NO: 596 - DNA, 631 bp, Artificial
  Glycine max FAD3A mutation created with TALEN pair GmFAD3_T01.1
cactgctttgttatgcctacctcatttcatttggctttagacaacttaaatttgagatctttattatgtttttgcttatatggtaaagtgattcagtggccatggaagcttttcagacagcccttttctaaatagcctggtgggacacatcttgcattcctcaattcttgtgccataccatggatggttagttcatcccggcttttttgtttgtcattgggaagttcttttattgattcaatttttatagcgtgttcggaaacgcgtttcagaaaataatgaaatacatcttgaatctgaaagttataacttttagcttcattgtcattgaaaagttcttttattaattatatttttaattgcgtgtttggaatcccatttgagaaaataagaaatcacgtttaaaatgtgaaagttataactattaactttgactaaacttgaaaaaatcacattttgatgtggaaccaaatctgatttgagaaccaagttgattttgatggattttgcaggagaattagccacagaactcaccatcaaaaatcatgggacacattgagaaggatgaatcctgggttccagtatgtgattaactacttcctctatagttattttgattcaattaaattta

SEQ ID NO: 597 - DNA, 671 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaaatgtgaaagttataactattaacttttgactaaacttgaaaaaatcacatttttgatgtggaaccaaatctgatttgagaaccaagttgattttgatggattttgcatggagaattagccacagaactcaccattcaaaatcatggacacattgagaaggattgaatcctgggttccagtatgtgattaactacttcctctatagttattttgattcaattaaatttatttattaataagttcaagaaaaaggaatc

SEQ ID NO: 598 - DNA, 736 bp, Artificial
  Glycine max FAD3A mutation created with TALEN pair GmFAD3_T01.1
  misc_feature (691): n is a or c or t or g
cactgctttgttatgcctacctcatttcatttggctttagacaacttaaatttgagatctttattatgttttttgcttatatggtaaagtgattcattcttcacattgaattgaacagacagtggccatggaagcttttcagacagcccttttctaaatagcctggtgggacacatcttgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttattttatttaataagttcaagaaaaatggaatctttntacttcagataaagctgttcttgaacattttttttcgtcattatc

SEQ ID NO: 599 - DNA, 738 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaaggaatcttatacttcagataaagctgttcttgaacattttttttagtcattatcttagttaaccgag

SEQ ID NO: 600 - DNA, 709 bp, Artificial
  Glycine max FAD3A mutation created with TALEN pair GmFAD3_T01.1
  misc_feature (676): n is a or c or t or g
cactgctttgttatgcctacctcatttcatttggctttagacaacttaaatttgagatctttattatgttttttgcttatatggtaaagtgattcattcttcacattgaattgatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacatttttgatgtggaaccaaatctgatttgagaaccaagttgattttgatggattttgcaggagaattagccacagaactcaccatcaaaaatcatggacacattgagaaggatgaatcctgggttccagtatgtgattaactacttcctctatagttattttgattcaattaaatttatttattaataagtcaagaaaaaaagggaatctttntactcagataaagctgtcttgaacatttttttt

SEQ ID NO: 601 - DNA, 713 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaatggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacatttttttt

SEQ ID NO: 602 - DNA, 730 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaatccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaggaatctttatacttcagataaagctgttcttgaacattttttttgtcattatcttagttaaccgag

SEQ ID NO: 603 - DNA, 636 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaattgtgaaagttataactattaactttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattc

SEQ ID NO: 604 - DNA, 710 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgacatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttattaataagttcaagaaaaaggaatctttatacttcagataaagctgttcttgaacattttttt

SEQ ID NO: 605 - DNA, 490 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaatgggaagcttttcagacagcccttttctaaatagcctggtgggacacatcttgcattcctcaattcttgtgccataccatggatggttagttcatcccggcttttttgtttgtcattggaagttcttttattgattcaattttatagcgtgttcggaaacgcgttcagaaaataatgaaatacatcttgaatctgaaagttataacttttagcttcattgtcattgaaagttctttttattaattatatttttattgcgtgtttggaatcccatttgagaaataagaaatcacgtttaaaaattgtgaaagttataactattaacttttgactaaacttgaaaaaatcacatttttgatgtggaaccaaatctga

SEQ ID NO: 606 - DNA, 737 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaaggaatctttatacttcagataaagctgttcttgaacattttttttgtcattatcttagttaaccgag

SEQ ID NO: 607 - DNA, 697 bp, Artificial
  Glycine max FAD3A mutation created with TALEN pair GmFAD3_T01.1
  misc_feature (651); (679): n is a or c or t or g
cactgctttgttatgcctacctcatttcatttggctttagacaacttaaatttgagatctttattatgttttttgcttatatggtaaagtgattcattcttcacattgaattgggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaaatttatttnttaataagtcagaaaaaaggaatctttntactcagataaagctgtc

SEQ ID NO: 608 - DNA, 597 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaacaatttttatagcgtgttcggaaacgcgtttcagaaaataatgaaatacatcttgaatctgaaagttataacttttagcttcattgtcattgaaagttcttttattaattatattttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttggcaggagaattagccacagaactcaccatcaaaatcatggacacattgagaaggatgaatcctgggttccagtatgtgattaactacttcctctatagttatttttgattcaattaaatttatttatttaataagttcaagtaaaaaagggaatcttttatacttcagataaaagctgttcttgaacatttttttagtcattatcttagtt

SEQ ID NO: 609 - DNA, 490 bp, Artificial
  Glycine max FAD3A mutation created with TALEN pair GmFAD3_T01.1
cactgctttgttatgcctacctcatttcatttggctttagtacaacttaaatttgagaattctttattatgttttttgcttatatggtaaagtgattcattcttcacattgagaggcagggtcggaacaggagagcgcacgagggagcttgccagggggaaacgcctggtatctttatagtcctgtcgggtttcgccagtggccatggaagcttttcagacagcccttttctaaatagcctggtgggacacatcttgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaat

SEQ ID NO: 610 - DNA, 636 bp, Artificial
  Glycine max FAD3A mutation created with TALEN pair GmFAD3_T01.1
  misc_feature (400): n is a or c or t or g
cactgctttgttatgcctacctcatttcatttggctttagacaacttaaatttgagatctttattatgtttttttgcttatatggtaaagtgattcattcttcacattgaattggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttatttaattatatttttattgcggttttggaaatcccatttgngaaataagaaatcacgtttaaaaattgtgaaagttataactattaacttttgactaaacttgaaaaaactcacatttttgatgtggaaccaaatctgattttgagaaccaagttgattttgatggattttgcaggagaattagccacagaactcaccatcaaaatcatggacacattgagaaggatgaatcctgggttccagtatgtgattaactacttcctctatagttattttt

SEQ ID NO: 611 - DNA, 715 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgattttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaaggaatctttatacttcagataaagctgttcttgaacatttttttt

SEQ ID NO: 612 - DNA, 575 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattggtggccatggaagcttttcagacagcccttttctaaaatagcctggtgggacacatcttgcattcctcaattcttgtgccataccatggatggttagttcatcccggcttttttggtttgtcattggaagttcttttattgattcaattttatagcgtgttcggaaacgcgttcagaaaataatgaaatacatcttgaatctgaaagttataacttttagcttcattgtcattgaaagttctttttattaaattatatttttcattgcgtgtttgggaaatcccatttgagaaataagaaatcacgtttaaaaattgtgaaagttataactattaacttttgactaaacttgaaaaaactcacatttttggatgtggaaccaaagtctgatttgagaaccaagttgattttgatggattttcgcaggagaattagccacagaactcaccatcaaaaagtcat

SEQ ID NO: 613 - DNA, 770 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaacaggcgctggagacggtccagcggctgttgccggtgctgtgccaggcccatggaagcttttcagacagcccttttctaaatagcctggcgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggtaatctttatacttcagataaagcatgttcttgaacattttttttgtcattatt

SEQ ID NO: 614 - DNA, 714 bp, Artificial
  Glycine max FAD3A mutation created with TALEN pair GmFAD3_T01.1
cactgctttgttatgcctacctcatttcatttggctttagacaacttaaatttgagatctttattatgtttttttgcttatatggtaaagtgattcattcttcacattgaatatggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttattaataagttcaagaaaaaggaatctttatacttcagataaagctgttcttgaacatttttttt

SEQ ID NO: 615 - DNA, 722 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaacaccacctgctccggggtcaagccgtgggcctggcacagcaccggcaacagccgctggaccgtctccagcgcctgcttggccatggaagcttttcagacagcccttttctaaatagcctggtgggacacatcttgcattcctcaattcttgtgccataccatggatggttagttcatcccggcttttttgtttgtcattggaagttctttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaattcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaa

SEQ ID NO: 616 - DNA, 728 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaatatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatattttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaaggaatctttatacttcagataaagctgttcttgaacatttttttgtcattatcttagttaaccgag

SEQ ID NO: 617 - DNA, 649 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttattta

SEQ ID NO: 618 - DNA, 721 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaatggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaaattgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaaatttatttatttaataagttcaagaaaaaagggaatctttatacttcagataaagctgttcttgaacatttttttt

SEQ ID NO: 619 - DNA, 744 bp, Artificial
  Glycine max FAD3A mutation created with TALEN pair GmFAD3_T01.1
  misc_feature (689): n is a or c or t or g
cactgctttgttatgcctacctcatttcatttggctttagacaacttaaatttgagatctttattatgttttttgcttatatggtaaagtgattcattcttcacattgaattgaatggccatggaagcttttcagacagaccttttctaaatagcctggtgggacacatcttgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaaacttgaaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttattttatttaataagttcaagaaaaatggaatctttntacttcagataaagctgttcttgaacattttttttcgtcattatctagttaaccg

SEQ ID NO: 620 - DNA, 732 bp, Artificial
  Glycine max FAD3A mutation created with TALEN pair GmFAD3_T01.1
actgtttgttatgcctacctcatttcatttggctttagacaacttaaatttgagatctttattatgttttttgcttatatggtaaagtgattcattcttcacattgaattgacatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaataagaaatcacgtttaaaatgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttattaataagttcaagaaaaaggaatctttatacttcagataaagctgttcttgaacatttttttagtcattatcttagttaaccgag

SEQ ID NO: 621 - DNA, 712 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttattaataagttcaagaaaaaggaatctttatacttcagataaagctgttcttgaacatttttttt

SEQ ID NO: 622 - DNA, 724 bp, Artificial
  Glycine max FAD3A mutation created with TALEN pair GmFAD3_T01.1
  misc_feature (682): n is a or c or t or g
cactgctttgttatgcctacctcatttcatttggctttagacaacttaaatttgagatctttattatgttttttgcttatatggtaaagtgattcattcttcacattgaattgacatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaattgtgaaagttataactattaacttttgactaaacttgaaaaaactcacatttttgatgtggaaccaaatctgatttgagaaccaagttgatttgatggattttgcaggagaattagccacagaactcaccatcaaaatcatggacacattgagaaggattgaatcctgggttccagtatgtgattaactacttcctctatagttatttttggatcaattaaatttatttatttaataagttcaagaaaaaagggaatctttntactcagataaagctgtctgaacatttttttagtcttatctt

SEQ ID NO: 623 - DNA, 736 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgacatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaattgtgaaagttataactattaacttttgactaaacttgaaaaaactcacattttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttattaataagttcaagaaaaaggaatctttatacttcagataaagctgttcttgaacattttttttagtcattatcttagttaaccgag

SEQ ID NO: 624 - DNA, 482 bp, Artificial
  Glycine max FAD3A mutation created with TALEN pair GmFAD3_T01.1
  misc_feature (273): n is a or c or t or g
cactgctttgttatgcctacctcatttcatttggctttagacaacttaaatttgagatctttattatgttttttgcttatatggtaaagtgattcattcttcacattgaattgaaggccatggaagcttttcagacagcccctttttctaaaatagcctggtgggacacatcttgcattcctcaattcttgtgccataccatggatggttagttcatcccggctttttttgtttgtcattggaagttcttttattgattcaattttatagcgngttcggaaacgcgtttcagaaaataatgaaatacatcttgaatctgaaagttataactttttagctttcattgtcatttgaaaagttctttttatttaaattatatttttattgcgtgttttgggaaatcccattttgagaaataagaaatcacgtttaaaaattgtgaaagttataactattaactttttgactaaactttgaaaaaa

SEQ ID NO: 625 - DNA, 715 bp, Artificial
  Glycine max FAD3A mutation created with TALEN pair GmFAD3_T01.1
  misc_feature (682): n is a or c or t or g
cactgctttgttatgcctacctcatttcatttggctttagacaacttaaatttgagatctttattatgttttttgcttatatggtaaagtgattcattcttcacattgaattgaatggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaatgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttattaataagtcagaaaaaagggaatctttntactcagataaagctgtcttgaacatttttttt

SEQ ID NO: 626 - DNA, 715 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaatgctggggggtcaagccgtgggcctggcacagcaccggcaacagccgctggaccgtctccagcggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacatttgagaaggatgaatcctgggtttccagtatgtgattaactacttcctctatagttatttttgattcaattaaatttattta

SEQ ID NO: 627 - DNA, 707 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatattttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaagggaatctttatacttcagataaagctgttcttgaacatttttttt

SEQ ID NO: 628 - DNA, 713 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaagggaatctttatacttcagataaagctgttcttgaacatttttttt

SEQ ID NO: 629 - DNA, 729 bp, Artificial
  Glycine max FAD3A mutation created with TALEN pair GmFAD3_T01.1
cactgctttgttatgcctacctcatttcatttggctttagacaacttaaatttgagatctttattatgttttttgcttaaataaataaagtgattcattcttcacattgccatggaagcttttcagacagcccttttctaaatagcctggtgggacacatctgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttctttttattaattatattttattgcgtgtttggaatcccatttgagaaataagaaatcacgtttaaaattgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttattattaataagttcaagaaaaagggaatcttatacttcagataaagctgttcttgaacatttttttagtcattatcttagttaaccgag

SEQ ID NO: 630 - DNA, 629 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgatggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaaattgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagtta

SEQ ID NO: 631 - DNA, 742 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattggccatggaagcttttcagacagcccttttctaaatagcctggtgggacacatcttgcattcttcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaaaggaatctttatacttcagataaagctgattcttgaacatttttttgtcaattatcttagttaaccgagaag

SEQ ID NO: 632 - DNA, 730 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgagcaggcgctggagacggtccagcggctgttgccggtgctgtgccaggcccacggcttgaccccccagccaggtggtgggccagtccgccacccatcggaaggcttttacatgacagcccctttttctaaatagcctggtgggacacatcttgcattcctcaattcttgtgccataccatggatggttagttcatcccggctttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaatcacattttgatgtggaaccaaatctgatttgagaaccaagttgattttgatggattttgcaggagaattagccacagaactcaccatcaaaatcatggacacattgagaagggatgaatcctgggttccagtatgtgattactacttcctctatagttatttttgattcaa

SEQ ID NO: 633 - DNA, 700 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaacacatcttgcattcctcaattcttgtgccataccatggatggttagttcatcccggcttttttgctttgttctattggaagttcttttattgatttcaatttttattagcgtgttcggaaacgacgttttcagaaaataatgaaatacatcttgaatctgaaagttataacttttagcttcattgtcattgaaaagttcttttattaattatatttttattgcgtgtttggaatcccatttgagaaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccaatcaaaatcatggacacattgagaaggatgaatcctgggttccagtatgtgattaactacttcctctatagttattttgattcaattaaatttattatttaataagttcaagaaaaaaggaatctttatacttcagataaagctgttacttgaacattttttttgtcattattcttagttaaccgag

SEQ ID NO: 634 - DNA, 585 bp, Artificial
  Glycine max FAD3A mutation created with TALEN pair GmFAD3_T01.1
cactgcttgttatgcctacctcatttcatttggctttagacaacttaaatttgagatctttattatgttttttgcttatatggtaaagtgattcattcttcacattgaattgagaactgagatacctacagcgtgagctatgagaaagcgccacgcttcccgaagggagaaaggcggacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaaacgcgtttcagaaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaagtcacattttgatgtggaaccaaatctgatttgagaaccaagttgatttt

SEQ ID NO: 635 - DNA, 802 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaacagggattgggggatcctatcagccgttcccagctggtgaagtccgagctggaggagaagaaatccgaagccatggaagcttttcagacagcccttttctaaatagcctggtgggacacatcttgcattcctcaattcttgtgccataccatggatggttagttcatcccggctttttgtttgtcattggaagttcttttattgattcaatttttatagcgtgttcggaaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacatttgagaaggtatgaatcctgggttccagtatgtgattaactacttcctctatagttatttttgattcaattaaattatttattataagtcaagaaaaaagggaatcttatacttcagataaagctgttcttgaacattttttttgtcattattctagtttaaccg

SEQ ID NO: 636 - DNA, 586 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagtttcttttattaattatattttttatttgcggtttcggaatcccatttgagaaataagaaattcacgtttaaaaattgtgaaagttataactattaacttttgactaaacttgaaaaaatcacatttttgatgtggaaccaaatctgattttgagaaccaagttgaattttgatggattttgcaggagaattagccacagaactcaccatcaaaatcatggactacattgagaagg

SEQ ID NO: 637 - DNA, 694 bp, Artificial
  Glycine max FAD3A mutation created with TALEN pair GmFAD3_T01.1
cactgctttgttatgcctacctcatttcatttggctttagacaacttaaatttgagatctttattatgtttttttgcttatatggtaaagtgattcattcttcacattgaattgaacagcaccggcaacagcgcctgcaccgtctccagcgcctgcttgccaccaatattgctggcgatggccaccacctgctccggggtcaagccgtgggcctggcacagcaccggcaacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttatgcgtgttggaatcccatttgagaaataagaatcacgtttaaatgtgaaagttataactattaacttttgactaaacttgaaaaagtcacatttttgatgtggaaccaaatctgatttgagaaccagttgattttgatggattttgcaggagaattagcccacagaactcaccatcaaaatcatggacacattgagaaggg

SEQ ID NO: 638 - DNA, 667 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaataatgaaatacatcttgaatctgaaagttataacttttagcttcattgtcattgaaagttcttttattaattatatttttattgcgtgtttggaatcccatttgagaaataagaaatcacgtttaaaatgtgaagttataactattaacttttgactaaacttgaaaaaatcacattttgatgtggaaccaaatctgatttgagaaccaagttgattttgatggattttgcaggagaattagccacagaactcaccatcaaaaatcatggacacattgagaaggatgaatcctgggttccagtatgtgattaactacttcctctatagttatttttgattcaattaaatttatttatttaataagttcaagaaaaaggaatctttatacttcagataaagctg

SEQ ID NO: 639 - DNA, 711 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcatttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaagttataactattaacttttgactaaacttgaaaaaatcacattttgatgtggaaccaaatctgatttgagaaccaagttgattttgatggattttgcaggagaattagccacagaactcaccatcaaaaatcatggacacattgagaaggatgaatcctgggttccagtatgtgattaactacttcctctatagttatttttgattcaattaaaatttattatttaataagttcaagaaaaaaggaatctttatacttcagataaagctgttacttgaactattttttttgtcattatcttagttaaccgagaa

SEQ ID NO: 640 - DNA, 734 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaatcagtccatggaagcttttcagacagcccttttctaaatagcctggtgggacacatcttgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacattttttttgtcattatcttagttaaccg

SEQ ID NO: 641 - DNA, 726 bp, Artificial
  Glycine max FAD3A mutation created with TALEN pair GmFAD3_T01.1
cactgctttgttatgcctacctcatttcatttggctttagacaacttaaatttgagatctttattatgtttttttgcttatatggtaaagtgattcattcttcacattgaattgagtggccatggaagcttttcagacagcccttttctaaatagcctggtgggacacatcttgcattcctcaattcttgtgccataccatggatggttagttcatcccggctttttttgtttgtcattggaagttcttttattgattcaatttttatagcgtgttcggaaacgcgtttcagaaaataatgaaatacatcttgaatctgaaagttataactttttagcttcattgtcattgaaaagttctttttattaattatatttttattgcgtgtttggaatcccatttgagaaataagaaatcacgtttaaaaattgtgaaagttataactattaacttttgactaaacttgaaaaaatcacatttttgatgtggaaccaaatctgatttgagaaccaagttgattttgatggattttgcaggagaattagccacagaactcaccatcaaaaatcatggacacattgagaaggatgaatcctgggttccagtatgtgattaactacttcctctatagttattttgattcaattaaaatttatttatttaataagttcaagaaaaaagggaatctttatacttcagataaagctgttcttgaacatttttttt

SEQ ID NO: 642 - DNA, 710 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaatggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttattattaataagttcaagaaaaaggaatctttatacttcagataaagctgttcttgaacattttttt

SEQ ID NO: 643 - DNA, 732 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgagccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatattttattgcgtgtttggaatcccatttgagaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttattaataagttcaagaaaaaaggaatctttatacttcagataaagctgttcttgaacatttttttagtcattatcttagttaaccgag

SEQ ID NO: 644 - DNA, 714 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaacgccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttattatttaataagttcaagaaaaaggaatctttatacttcagataaagctgttcttgaacattttttt

SEQ ID NO: 645 - DNA, 708 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaagggaatctttatacttcagataaagctgttcttgaacattttttt

SEQ ID NO: 646 - DNA, 738 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaaattatatttttattgcgtgtttggaatcccatttgagaaataagaaatcacgtttaaaaattgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttattattaataagttcaagaaaaagggaatcttatacttcagataaagctgttcttgaacattttttttagtcattatcttagttaaccgag

SEQ ID NO: 647 - DNA, 592 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgattttgagaaccaagttgaattttgatggattttgcaggagaattagccacagaactcaccatcaaaatcatggacacattgagaaggattgaatcctggg

SEQ ID NO: 648 - DNA, 637 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacatatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatattttattgcgtgtttggaatcccatttgagaaataagaaatcacgtttaaaaatgtgaaagttataactattaacttttgactaaacttgaaaaaatcacattttgatgtggaaccaaatctgatttgagaaccaagttgaattttgatggattttgcatggagaattagtcacagaactcaccattcaaaatcatggacacattgagaaggatgaatcctgggttccagtatgtgattaactacttcctctatagttattttgattcaattaaatttattt

SEQ ID NO: 649 - DNA, 628 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaatatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatattttcattgcgtgtttggaatcccatttgagaaataagaaatcacgtttaaaaattgtgaaatgttataactattaacttttgactaaacttgaaaaaactcacatttttgatgtggaaccaaatctgatttgagaaccaagttgatttgatggattttgcaggagaattagccacagaactcaccatcaaaatcatggacacattgagaaggatgaatcctgggttccagtatgtgattaactacttcctctatagttatttttgg

SEQ ID NO: 650 - DNA, 645 bp, Artificial
  Glycine max FAD3A mutation created with TALEN pair GmFAD3_T01.1
cactgctttgttatgcctacctcatttcatttggctttagacaacttaaatttgagatctttattatgtttttttgcttatatggtaaagtgattcattcttcacattgaattggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaaattatatttttattgcgtgtttggaatcccatttgagaaataagaaatcacgtttaaaattgtgaaagttataactattaacttttgactaaacttgaaaaaactcacattttttggattgtggaacccaaaatctgattttgagaaccaagttgattttgatggatttttgcaggagaattagccacagaactcaccatcaaaatcatggacacattgagaaggattgaatcctgggttccagtatgtgattaactacttcctctatagtttatttttgga

SEQ ID NO: 651 - DNA, 730 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaatggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaagggaatcttatacttcagataaagctgttcttgaacatttttttagtcattatcttag

SEQ ID NO: 652 - DNA, 673 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaatatggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttattaataagttcaagaaaaaggaatc

SEQ ID NO: 653 - DNA, 507 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataactttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaag

SEQ ID NO: 654 - DNA, 487 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggttaaagtgattcattcttcacattgaattgggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttcttttattaattatatttttattgcgtgtttggaatcccatttgagaaataagaaatcacgtttaaaaatgtgaaagttataactattaacttttgactaaaacttgaaaaaatcacatttttgatgtggaacc

SEQ ID NO: 655 - DNA, 713 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcatggaagcttttcagacagcccttttctaaatagcctggtgggacacatcttgcattcctcaattcttgtgccataccatggatggttagttcatcccggcttttttgtttgtcattggaagttcttttattgattcaattttttatagcgtgttcggaaactgcgtttcagaaaataatgaaatacatcttgaatctgaaagttataacttttagcttcattgtcattgaaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacattttttttgtcattatcttagttaacc

SEQ ID NO: 656 - DNA, 715 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaaggaatctttatacttcagataaagctgttcttgaacatttttttt

SEQ ID NO: 657 - DNA, 686 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaatagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatattttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaagggaatctttatacttcagataaagctg

SEQ ID NO: 658 - DNA, 648 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttatttaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttattta

SEQ ID NO: 659 - DNA, 728 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattaacagtggccatggaagcttttcagacagcccttttctaaatagcctggtgggacacatcttgcattcctcaattcttgtgccataccatggatggttagttcatcccggcttttttgtttgtcattggaagttcttttattgattcaattttttatagcgtgttcggaaacgcgtttcagaaataatgaaatacatcttgaatctgaaagttataacttttagcttcattgtcattgaaaagttcttttattaattatatttttattgcgtgtttggaatcccatttgagaaataagaaatcacgtttaaaatgtgaaagttataactattaacttttgactaaacttgaaaaaattcacatttttgatgtggaaccaaatctgatttgagaaccaagttgattttgatggattttgcaggagaattagccacagaacttcaccatcaaaaatcatggacacattgagaaggatgaatcctgggttccagtatgtgattaactacttcctctatagttattttgattcaattaaatttatttatttaataagttcaagaaaaaaggaatctttatacttcagataaagctgttcttgaacattttttttagtcattatcttagttaacc

SEQ ID NO: 660 - DNA, 660 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgagccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaaatgtgaaagttataactattaacttttgactaaacttgaaaaaatcacatttttgatgtggaaccaaatctgattttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataag

SEQ ID NO: 661 - DNA, 792 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaacctgttgccggtgctgtgccaggcccacggcttgaccccccagcaggtggtggccatcgccagcaatggcggtggcaagcaggcgctggagacggtggccatggaagcttttcagacagcccttttctaaatagcctggtgggacacatcttgcattcctcaattcttgtgccataccatggatggttagttcatcccggctttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaatcacattttgatgtggaaccaaatctgatttgagaaccaagttgatttgatggattttgcaggagaattagccacagaactcaccatcaaaatcatggacacattgagaaggatgaatcctgggttccagtatgtgattaactatcttcctctatagttatttttgattcaattaaattttattatttaataagttcaagaaaaaggaatctttatacattgacagattaaa

SEQ ID NO: 662 - DNA, 735 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaaggaatcttatacttcagataaagctgattcttgaacatttttttgtcattatcttagttaaccgag

SEQ ID NO: 663 - DNA, 698 bp, Artificial
  Glycine max FAD3A mutation created with TALEN pair GmFAD3_T01.1
cactgctttgttatgcctacctcatttcatttggctttagtacaacttaaatttgagaattctttatttatgttttttgcttatatggtaaagtgattcattcttcacattgagaggcagggtcggaacaggagagcgcacggagggagcttgccagggggaaacgcctggtatctttatagtcctgtcgggtttcgccagtggccatggaagcttttcagacagcccttttctaaatagcctggtgggacacatcttgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaatcacatttttgatgtggaaccaaatctgatttgagaaccaagttgattttgatggattttgcaggagtaattagccacaagaactcaccatcaaatcatggacacattgagaaggatgaatcctgggttccagtatgtgttaac

SEQ ID NO: 664 - DNA, 651 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaattgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttattta

SEQ ID NO: 665 - DNA, 765 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaacagccgctggaccgtctccagcgcctgcttgccaccattattgctggcgatggccaccacctgctggggggtcaagccgtgggcctgccatggaagcttttcagacagcccttttctaaatagcctggtgggacacatcttgcattcctcaattcttgtgccataccatggatggttagttcatcccggcttttttgtttgtcattggaagttctttttattgattcaatttttatagcgtgttcggaaaacgcgtttcagaaaataatgaaatacatcttgaatctgaaagttataacttttagcttcattgtcattgaaagttcttttattaattatattttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatcttt

SEQ ID NO: 666 - DNA, 739 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaagggaatctttatacttcagataaagctgttcttgaacattttttttagtcattatcttagttaaccgag

SEQ ID NO: 667 - DNA, 710 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgattttgacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttaattgcgtgtttggaatcccatttgagaaaataagaaactcactgatttaaatgtagaagttataactattaacttttgactaaacttgaaaaaatcacattttgatgtggaaccaaatctgatttgagaaccaagttgattttgatggattttgcaggagaattagccacagaactcaccatcaaaaatcatggacacattgagaaggatgaatcctgggttccagtatgtgattaactacttcctctatagttatttttgattcaattaaatttatttatttaataagttcaagaaaaagggaatctttatacttcagataaagctgttcttgaacattttttttagtcattatc

SEQ ID NO: 668 - DNA, 683 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcaggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttcttttattaattatatttttattgcgtgtttggaatcccatttgagaaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaaatcatggacacattgagaaggatgaatcctgggttccagtatgtgattaactacttcctctatagttatttttgattcaattaaaatttatttatttaaataagttcaagaaaaaaggaatctttatacttcagataaagctg

SEQ ID NO: 669 - DNA, 723 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacatcatggaagcttttcagacagcccttttctaaatagcctggtgggacacatctgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatattttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttattaataagttcaagaaaaaggaatctttatacttcagataaagctgttcttgaacatttttttagtcattatcttagttaaccgag

SEQ ID NO: 670 - DNA, 708 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatattttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaaagggaatctttatacttcagataaagctgttcttgaacatttttttt

SEQ ID NO: 671 - DNA, 706 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcagacagcccttttctaaatagcctggtgggacacatcttgcattcctcaattcttgtgccataccatggatggttagttcatcccggcttttttgtttgtcattggaagttcttttattgattcaattttttatagcgtgttcggaaacgcgtttcagaaataatgaaatacatcttgaatctgaaagttataacttttagcttcattgtcattgaaaagttcttttattaattatatttttattgcgtgtttggaatcccatttgagaaataagaaatcacgtttaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttattatttaataagttcaagaaaaaaggaatctttatacttcagataaagctgttcttgaacattttttttgtcattatcttagttaaccgag

SEQ ID NO: 672 - DNA, 737 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaaaggaatctttatacttcagataaagctgttcttgaacattttttttgtcattatcttagttaaccgag

SEQ ID NO: 673 - DNA, 730 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaatggcgatggccaccacctgctggggggtcaagccgtgggcctggcacagcaccggcaacagccgctggaccgtctccaaccatggaagctttttcagacagccctttttctaaatagcctggtgggacacatcttgcattcctcaattcttgtgccataccatggatggttagttcatcccggcttttttgtttgtcattggaagttcttttattgattcaatttttatagcgtgttcggaaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttattta

SEQ ID NO: 674 - DNA, 740 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaccgctgcaccgtctccagcgcctgcttgccaccatgtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaagtcatggacacattgagaaggatgaatcctgggttccagtatgtgattaacctacttcctctatagttatttttgattcaattaaatttatttatttaataagttcaagaaaaatggaatctttatacttcagataaagctgttc

SEQ ID NO: 675 - DNA, 736 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaacaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatattttattgcgtgtttggaatcccatttgagaaataagaaatcacgtttaaaaattgtgaaagttataactattaacttttgactaaacttgaaaaaactcacatttttgatgtggaaccaaatctgatttgagaaccaagttgatttgatggattttgcagagaattagccacagaactcaccatcaaaatcatggacacattgagaaggatgaatcctgggttccagtatgtgattaactacttcctctatagttatttttgattcaattaaatttatttatttaataagttcaagaaaaaaagggaatctttatacttcagataaagctgttcttgaacattttttttagtcattatcttagttaaccgag

SEQ ID NO: 676 - DNA, 740 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaaattgtgaaagttataactattaactttttgactaaacttgaaaaaactcacattttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttattaataagttcaagaaaaaggaatctttatacttcagataaagctgttcttgaacattttttttagtcattatcttagttaaccgag

SEQ ID NO: 677 - DNA, 733 bp, Artificial
  Glycine max FAD3A mutation created with TALEN pair GmFAD3_T01.1
  misc_feature (149): n is a or c or t or g
cactgctttgttatgcctacctcatttcatttggctttagacaacttaaatttgagatctttattatgttttttgcttatatggtaaagtgattcattcttcacattgaattgaaggccatggaagctttttcagacagccctttttcnaaaatagcctggtgggacacatcttgcattcctcaattcttgtgccataccatggatggttagttcatcccggcttttttgtttgtcattggaagttcttttattgattcaattttatagcgtgttcggaaacgcgttcagaaaataatgaaatacatcttgaatctgaaagttataactttttagcttcattgtcattgaaagttctttttattaattatatttttattgcgtgtttggaatcccatttgagaaataagaaatcacgtttaaaaatgtgaaagttataactattaacttttgactaaacttgaaaaaatcacatttttgatgtggaaccaaatctgattgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaagggaatctttatacttcagataaagctgttcttgaacattttttttagtcattatcttag

SEQ ID NO: 678 - DNA, 764 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaacaggcgctggagacggtccagcggctgttgccggtgctgtgccaggcccacggcttgaccccccagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaagggaatctttatacttcagataaa

SEQ ID NO: 679 - DNA, 496 bp, Artificial
  Glycine max FAD3A mutation created with TALEN pair GmFAD3_T01.1
cactgctttgttatgcctacctcattttcatttggctttagacaacttaaatttgagatctttattatgttttttgcttatatggtaaagtgattcattcttcacattgaattgacatggaagcttttcagacagccctttctaaatagcctggtgggacacatcttgcattcctcaattcttgtgccataccatggatggttagttcatcccggcttttttgtttgtcattggaagttcttttattgattcaatttttatagcgttgttcggaaacgcgtttcagaaaataatgaaatacatcttgaatctgaaagttataactttttagcttcattgtcattgaaagttcttttattaattatatttttattgcgtgtttggaatcccatttgagaataagaaatcacgtttaaaatgtgaaagttataactattaacttttgactaaacttgaaaaaatcacatttttgatgtggaaccaaatctgatttgag

SEQ ID NO: 680 - DNA, 732 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatattttattgcgtgtttggaatcccatttgagaaataagaaatcacgtttaaaaatgtgaaagttataactattaacttttgactaaacttgaaaaaatcacatttttgatgtggaaccaaatctgattttgagaaccaagttgaattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaaggaatctttatacttcagataaagctgattcttgaacatttttttgtcattatcttagttaaccgag

SEQ ID NO: 681 - DNA, 635 bp, Artificial
  Glycine max FAD3A mutation created with TALEN pair GmFAD3_T01.1
cactgctttgttatgcctacctcattccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaaacttgaaaaaattcacatttttgatgtggaaccaaatctgatttgagaaccaagttgattttgatggatttttgcaggagaattagccacagaactcaccatcaaaatcatggacacattgagaagggatgaatcctgggttccagtatgtgattaactacttcctctatagttatttttgattcaattaatttattattatagttcagaaaaaggatctttatacttcagataaagctgttcttgaacattttttttgtcattatcttagtt

SEQ ID NO: 682 - DNA, 583 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgcatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaataagaaatcacgtttaaaatgtgaaagttataactattaacttttgactaaaacttgaaaaaactcacatttttgatgtggaaccaaatctgatttgagaaccaagttgattttgatggattttgcaggagaattagccacagaactcaccatcaaaatcatggacacattgagaaggattgaatcc

SEQ ID NO: 683 - DNA, 518 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgtggcgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggtggccatggaagcttttcagacagcccttttctaaatagcctggtgggacacatcttgcattcctcaattcttgtgccataccatggatggttagttcatcccggctttttgtttgtcatggaagttcttttattgattcaatttttatagcgtgttcggaaacgcgtttcagaaataatgaatacatcttgatctgaaagttataactttagcttcattgtcattgaaagttc

SEQ ID NO: 684 - DNA, 707 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattcatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttattaataagttcaagaaaaaggaatctttatacttcagataaagctgttcttgaacattttttt

SEQ ID NO: 685 - DNA, 626 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaagccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttatttgcggtttggaatcccatttgagaaataagaaatcacgtttaaaattgtgaaagttataactattaacttttgactaaacttgaaaaaatcacatttttgatgtggaaccaaatctgattttgagaaccaagttgaattttgatggattttgcaggagaattagccacagaactcaccatcaaaatcatggacacattgagaaggatgaatcctgggttccagtatgtgattaactacttcctctatag

SEQ ID NO: 686 - DNA, 734 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatattttattgcgtgtttggaatcccatttgagaaataagaaatcacgtttaaaattgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacatctgaaggaatggaatgacctgggttccagtatgtgattaactacttcctctatagttattttgattcaattaaatttattattaataagttcaagaaaaaggaatcttatacttcagataaagctgttcttgaacatttttttagtcattatcttagttaaccgag

SEQ ID NO: 687 - DNA, 567 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaaccaaaatctgatttgagaaccaagttgattttgatggattttgcaggagaattagccacagaactcaccatcaaaaatcatggacacattgagaaggatgaatcctgggttccagtatgtgattaactacttcctctatagttatttttgattcaattaaatttatttatttaataagttcaagaaaaaaggaatcttatacttcagataagctgttcttgaacattttttttgtcattatctt

SEQ ID NO: 688 - DNA, 739 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgacatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaaattgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttattaataagttcaagaaaaagggaatctttatacttcagataaagctgttcttgaacattttttttagtcattatcttagttaaccgag

SEQ ID NO: 689 - DNA, 735 bp, Artificial
  Glycine max FAD3A mutation created with TALEN pair GmFAD3_T01.1
  misc_feature (492): n is a or c or t or g
cactgctttgttatgcctacctcatttcatttggctttagacaacttaaatttgagatctttattatgttttttgcttatatggtaaagtgattcattcttcacattgaattgaccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaaattatatttttattgcgtgtttggaatcccatttgagaaataagaaatcacgtttaaaaattgtgaaagttataactattaacttttgactaaacttgaaaaaactcacatttttgatgtggaaccaaanctgatttgagaaccaagttgatttgatggattttgcaggagaattagccacagaactcaccatcaaaatcatggacacattgagaaggatgaatcctgggttccagtatgtgattaactacttcctctatagttattttgatcaattaaatttattattaataagttcaagaaaaaggaatcttatacttcatgataaagctgttcttgaacatttttttagtcattatcttagttaaccgag

SEQ ID NO: 690 - DNA, 710 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgacatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttattaataagttcaagaaaaaggaatctttatacttcagataaagctgttcttgaacatttttttt

SEQ ID NO: 691 - DNA, 696 bp, Artificial
  Glycine max FAD3A mutation created with TALEN pair GmFAD3_T01.1
cactgctttgttatgcctacctcatttcatttggctttagacaacttaaatttgagatctttattatgtttttttgcttatatggtaaagtgattcattcttcacattgaatatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgaattttgatggattttgcaggagaattagccacagaactcaccatcaaaatcatggacacattgagaaggatgaatcctgggttccagtatgtgattaactacttcctctatagttatttttgattcaattaaatttatttattaataagttcaagaaaaaaggaatctttatacttcagataaagctgttc

SEQ ID NO: 692 - DNA, 694 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgtggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaaatgtgaaagttataactattaacttttgactaaacttgaaaaaatcacatttttgatgtggaaccaaatctgattttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaaaggaatctttatacttcagataaagct

SEQ ID NO: 693 - DNA, 731 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaaggaatctttatacttcagataaagctgttcttgaacatttttttgtcattatcttagttaaccgag

SEQ ID NO: 694 - DNA, 710 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaagttataactattaacttttgactaaacttgaaaaaatcacatttttgatgtggaaccaaatctgatttgagaaccaagttgattttgatggattttgcaggagaattagccacagaactcaccatcaaaaatcatggacacattgagaaggatgaatcctgggttccagtatgtgattaactacttcctctatagttatttttgattcaattaaaatttatttatttaataagttcaagaaaaaggaatctttatacttcagataaagctgttcttgaacattttttttgtcattatcttagttaaccgagaa

SEQ ID NO: 695 - DNA, 632 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattggtatttcacaccgcatatggtgcactctcagtacaatctgctctgatgccgcatagttaagccagccccgacacccgccaacacccgctgacgcgccctgacgggcttgtctgctcccggcttccgcttacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaataatgaaatacatcttgaatctgaaagttataacttttagcttcattgtcattgaaagttcttttattaattatatttttattgcgtgtttggaatcccatttgagaaataagaaatcacgtttaaaatgtgaaagttatactattaactttgactaaacttgaaaaaaatcacatttttgtgtggaaccaaatctgatttgagaacc

SEQ ID NO: 696 - DNA, 669 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcggttcggaatcccatttgtgaaataagcaaattcacgtttaaaaatgtgaaagttataactattaacttttgactaaacttgaaaaaatcacatttttgatgtggaaccaaatctgattttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttattaataagttcaagaaaaa

SEQ ID NO: 697 - DNA, 731 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaaattgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttattattaataagttcaagaaaaaggaatcttatacttcagataaagctgttcttgaacatttttttgtcattatcttagttaaccgag

SEQ ID NO: 698 - DNA, 739 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaacccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaaatgtgaaagttataactattaacttttgactaaacttgaaaaaatcacatttttgatgtggaaccaaatctgattttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaaggaatctttatacttcagataaagctgattcttgaacatttttttgtcattatcttagttaaccgag

SEQ ID NO: 699 - DNA, 686 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttcttttattaattatattttattgcgtgtttggaatcccatttgagaaataagaaatcacgtttaaaaatgtgaaagttataactattaacttttgactaaacttgaaaaaatcacattttgatgtggaaccaaatctgattttgagaaccaagttgaattttgatggattttgcaggagaattagccacagaactcaccattcaaaaatcatggacacattgagaaggatgaatcctgggttccagtatgtgattaactacttcctctatagttattttgattcaattaaatttatttatttaataagttcaagaaaaaaaggaatctttatacttcagataaagc

SEQ ID NO: 700 - DNA, 767 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcaattcttgtgcgccgggtgttggcttaacgctgccgggtgttggcttaacgcaacgatgtgcgcgtgtgtaaaccagtggccatggaagctttttcagacagccctttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttataagttcaagaaaaaggaatctttatacttcagataaagctgttctt

SEQ ID NO: 701 - DNA, 708 bp, Artificial
  Glycine max FAD3A mutation created with TALEN pair GmFAD3_T01.1
tactgctttgttatgcctacctcatttcatttggctttagacaacttaaatttgagatctttattatgttttttgcttatatggtaaagtgattcattcttcacatgccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgattttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaagggaatctttatacttcagataaagctgttcttgaacatttttttt

SEQ ID NO: 702 - DNA, 595 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaatgtgaaagttataactattaacttttgactaaacttgaaaaaactcacatttttgatgtggaaccaaatctgatttgagaaccaagttgatttgatggattttgcaggagaattagccacagaactcaccatcaaaatcatggacacattgagaaggatgaatcctgggttccagt

SEQ ID NO: 703 - DNA, 733 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaatggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttattattaataagttcaagaaaaaggaatcttatacttcagataaagctgttcttgaacatttttttagtcattatcttagttaaccgagaag

SEQ ID NO: 704 - DNA, 739 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaagccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaatgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaagggaatctttatacttcagataaagctgttcttgaacatttttttagtcattatcttagttaaccgag

SEQ ID NO: 705 - DNA, 737 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaaattgtgaaagttataactattaacttttgactaaacttgaaaaaactcacattttttgatgtggaaccaaatctgatttgagaaccaagttgatttgatggattttgcaggagaattagccacagaactcaccatcaaaatcatggacacattgagaaggatgaatcctgggttccagtatgtgattaactacttcctctatagttattttgattcaattaaatttattattaataagttcaagaaaaaggaatcttatacttcagataaagctgttcttgaacattttttttagtcattatcttagttaaccgag

SEQ ID NO: 706 - DNA, 713 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacatttttttt

SEQ ID NO: 707 - DNA, 708 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatattttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgaattttgatggattttgcaggagaattagccacagaactcaccatcaaaatcatggacacattgagaaggatgaatcctgggttccagtatgtgattaactacttcctctatagttatttttgattcaattaaatttatttattaataagttcaagaaaaaggaatctttatacttcagataaagctgttcttgaacattttttt

SEQ ID NO: 708 - DNA, 582 bp, Artificial
  Glycine max FAD3A mutation created with TALEN pair GmFAD3_T01.1
  misc_feature (567): n is a or c or t or g
cactgctttgttatgcctacctcatttcatttggctttagacaacttaaatttgagatctttattatgttttttgcttatatggtaaagtgattcattcttcacattgaattgaacagcaccggcaacagcgcctgcaccgtctccagcgcctgcttgccaccaatattgctggcgatggccaccacctgctccggggtcaagccgtgggcctggcacagcaccggcaacagtggccatggaagcttttcagacagcccttttctaaatagcctggtgggacacatcttgcattcctcaattcttgtgccataccatggatggttagttcatcccggctttttgtttgtcattggaagttcttttattgattcaatttttatagcgtgttcggaaacgcgttcagaaataatgaaatacatcttgaatctgaaagttataacttttagcttcattgtcattgaaagttcttttaattaattatatttttattgcgtgtttggaatccccatttgagaaataagaaatcacgtttaaaattgtgaaagttataactattaacttttgnctaaacttgaaaaaa

SEQ ID NO: 709 - DNA, 688 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaataatgaaatacatcttgaatctgaaagttataacttttagcttcattgtcattgaaagttcttttattaattatatttttattgcgtgtttggaatcccatttgagaaataagaaatcacgtttaaatgtgaaagttataactattaacttttgactaaacttgaaaaaatcacatttttgatgtggaaccaaatctgatttgagaaccaagttgattttgatggattttgcaggagaattagccacagaactcaccatcaaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacatttttttt

SEQ ID NO: 710 - DNA, 638 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatattttattgcgtgtttggaatcccatttgagaataagaaatcacgtttaaaaatgtgaaagttataactattaacttttgactaaacttgaaaaaactcacattttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattc

SEQ ID NO: 711 - DNA, 705 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaacaagattgcaaaacgtggcggcgtgaccgcagtggaggcagtgcatgcatggcgcaatgcactgacgggtgccccgctcaacttgaccccccagcaggtgatggccatggaagcttttcagacagcccttttctaaatagcctggtgggacacatcttgcattcctcaattcttgtgccataccatggatggttagttcatcccggctttttgtttgtcattggaagttcttttattgattcaatttttatagcgtgttcggaaacgcgtttcagaaataatgaatacatcttgaatctgaaagttataacttttagcttcattgtcattgaaagttcttttattaattatatttttattgcgtgtttggaatcccatttgagaaataagaaatcacgtttaaaatgtgaaagttataatctattaacttttgactaaacttgaaaaaatcacattttgatgtggaaccaaatctgatttgagaaccaagttgattttgatggattttgcaggagaattagccacagaactcaccatcaaaatcatggacacattgagaagggatgaatcctgggttccagtatgtgatt

SEQ ID NO: 712 - DNA, 733 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacatttggccatggaagcttttcagacagcccttttctaaatagcctggtgggacacatctgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatattttattgcgtgtttggaatcccatttgagaaataagaaatcacgtttaaaattgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaagggaatctttatacttcagataaagctgttcttgaacatttttttagtcattatcttagttaaccgag

SEQ ID NO: 713 - DNA, 682 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattaaatagcctggtgggacacatcttgcattcctcaattcttgtgccataccatggatggttagttcatcccggctttttttgtttgtcattggaagttcttttattgattcaatttttatagcgtgttcggaaacgcgtttcagaaaataatgaaatacatcttgaatctgaaagttataacttttagcttcattgtcattgaaaagttcttttattaattatatttttaattgcgtgtttggaatcccatttgagaaataagaaatcacgtttaaaatgtgaaagttataactattaactttgactaaacttgaaaaaatcacattttgatgtggaaccaaatctgatttgagaaccaagttgattttgatggattttgcaggagaattagccacagaactcaccatcaaaaatcatggacacattgagaaggatgaatcctgggttccagtatgtgattaactacttcctctatagttattttgattcaattaaatttattatttaataagttcaagaaaaaaggaatctttatacttcagataaagctgttcttgaacatttttttta

SEQ ID NO: 714 - DNA, 708 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaactggaagcttttcagacagcccttttctaaatagcctggtgggacacatcttgcattcctcaattcttgtgccataccatggatggttagttcatcccggcttttttgtttgtcattggaagttcttttattgattcaattttatagcgtgttcggaaacgcgtttcagaaaataatgaaatacatcttgaatctgaaagttataactttttagcttcattgtcattgaaagttctttttattaattatattttattgcgtgtttggaatcccatttgagaaataagaaatcacgtttaaaattgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttattattaataagttcaagaaaaaggaatcttatacttcagataaagctgttcttgaacattttttt

SEQ ID NO: 715 - DNA, 736 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttattaataagttcaagaaaaaggaatcttatacttcagataaagctgattcttgaacatttttttgtcattatcttagttaaccgag

SEQ ID NO: 716 - DNA, 733 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaaccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaattgtgaaagttataactattaacttttgactaaacttgaaaaaactcacattttttgatgtggaaccaaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttattatttaataagttcaagaaaaagggaatctttatacttcagataaagctgttcttgaacattttttttagtcattatcttag

SEQ ID NO: 717 - DNA, 731 bp, Artificial
  Glycine max FAD3A mutation created with TALEN pair GmFAD3_T01.1
cactgctttgttatgcctacctcatttcatttggctttagacaacttaaatttgagatctttattatgtttttttgcttatatggtaaagtgattcattcttcacattgaattgaactggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaaattgtgaaagttataactattaactttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttattaataagttcaagaaaaagggaatctttatacttcagataaagctgttcttgaacattttttttagtcattatcttag

SEQ ID NO: 718 - DNA, 612 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaaattgtgaaatgttataactattaacttttgactaaacttgaaaaaactcacatttttgatgtggaaccaaatctgatttgagaaccaagttgatttgatggattttgcaggagaattagccacagaactcaccatcaaaatcatggacacattgagaaggattgaatcctgggttccagtatgtgattaac

SEQ ID NO: 719 - DNA, 733 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaaagggaatctttatacttcagataaagctgttcttgaacattttttttagtcattatcttagttaaccgag

SEQ ID NO: 720 - DNA, 738 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgagccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaagggaatctttatacttcagataaagctgttcttgaacattttttttgtcattatcttagttaaccgag

SEQ ID NO: 721 - DNA, 623 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttcttttattaattatattttattgcgtgtttggaatcccatttgagaaataagaaatcacgtttaaaaattgtgaaagttataactattaacttttgactaaaacttgaaaaaactcacatttttgatgtggaaccaaatctgatttgagaaccaagttgatttgatggattttgcaggagaattagccacagaactcaccatcaaaatcatggacacattgagaaggatgaatcctgggttccagtatgtgattaactacttcctctatagttattttt

SEQ ID NO: 722 - DNA, 720 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacataagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgaattttgatggattttgcatggagaattagccacagaactcaccattcaaaatcatggacacattgagaaggatgaatcctgggttccagtatgtgattaactacttcctctatagttattttgattcaattaaatttatttatttaataagttcaagaaaaaaggaatcttatacttcagataaagctgttcttgaacatttttttgtcattatcttagttaaccgag

SEQ ID NO: 723 - DNA, 690 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcatttgtcattgaaagttcttttattaattatattttattgcgtgtttggaatcccatttgagaaataagaaatcacgtttaaaaatgtgaaagttataactattaacttttgactaaacttgaaaaaatcacatttttgatgtggaaccaaatctgattttgagaaccaagtttgaattttgatggattttgcaggagaattagccacaagaactcaccattcaaaatcatggacacattgagaaggatgaatcctgggttccagtatagtgattaactacttcctctatagttatttttgattcaattaaatttatttatttaataagttcaagaaaaaaggaatctttatacttcagataaagctg

SEQ ID NO: 724 - DNA, 599 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaacaatttttatagcgtgttcggaaacgcgtttcagaaaataatgaaatacatcttgaatctgaaagttataacttttagcttcattgtcattgaaagttcttttattaattatattttttattgcgtgttttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaattatttatttaataagttcaagaaaaaggaatctttatacttcagataaagctgttcttgaacattttttttagtcattatcttagttaaccgag

SEQ ID NO: 725 - DNA, 750 bp, Artificial
  Glycine max FAD3A mutation created with TALEN pair GmFAD3_T01.1
cactgctttgttatgcctacctcatttcatttggctttagacaacttaaatttgagatctttattatgtttttttgcttatatggtaaagtgattcattcttcacattgaattgaggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataactttttagcttcattgtcattgaaagttctttttattaattatatttttattgcgtgtttggaatcccatttgagaaataagaaatcacgtttaaaaattgtgaaagttataactattaactttttgactaaacttgaaaaaactcacattttttggatgtggaaccaaatctgattttgagaaccaagttgattttgatggatttttgcaggagaattagccacagaactcaccatcaaaatcatggacacattgagaaggatgaatcctgggttccagtatgtgattaactacttcctctatagttatttttgattcaattaaatttatttatttaataagttcaagaaaaagggaatctttatacttcagataaagctgttcttgaacattttttttagtcattatcttagttaaccgag

SEQ ID NO: 726 - DNA, 622 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaattgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatag

SEQ ID NO: 727 - DNA, 739 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaatggccatggaagcttttcagacagcccttttctaaatagcctggtgggacacatcttgcattcctcaattcttgtgccataccatggatggttagttcatcccggcttttttgtttgtcattggaagttcttttattgattcaattttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaaattgtgaaagttataactattaacttttgactaaacttgaaaaaatcacatttttgatgtggaaccaaatctgatttgagaaccaagttgattttgatggattttgcaggagaattagccacagaactcaccatcaaaaatcatggacacattgagaaggatgaatcctgggttccagtatgtgattaactacttcctctatagttattttgattcaattaaatttatttatttaataagttcaagaaaaaagggaatctttatacttcagataaagctgttcttgaacattttttttagtcattatcttagtttaaccgag

SEQ ID NO: 728 - DNA, 751 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgatttcatttggctttgttatgccggtgctgtgccaggccatggaagcttttcagacagcccttttctaaatagcctggtgggacacatcttgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttcgtcattatcttagttaaccg

SEQ ID NO: 729 - DNA, 715 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgagccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagtttgattttgatggattttgcaggagaattagccacagaactcaccatcaaaatcatggacacattgagaaggatgaatcctgggttccagtatgtgattaactacttcctctatagttatttttgattcaattaaatttatttattaataagttcaagaaaaaggaatctttatacttcagataaagctgttcttgaacatttttttt

SEQ ID NO: 730 - DNA, 794 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattggttgccggtgctgtgccaggcccacggcttgaccccggagcaggtggtggccatcgccagcaatattggtggcaagcagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaactttgactaaacttgaaaaaatcacattttgatgtggaaccaaatctgatttgagaaccaagttgattttgatggattttgcaggagaattagccacagaactcaccatcaaaatcatggacacatttgagaaggatgaatcctgggttccagtatgtgattaactacttcctctatagttatttttgattcaattaaatttatttatttaataagttcaagaaaaaggaatctttatacttcagataaagctgttcttgaacattttttttt

SEQ ID NO: 731 - DNA, 794 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgtgccaggcccacggcttgaccccccagcaggtggtggccatcgccagcaatggcggtggcaatggccatggaagcttttcagacagccctttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaaggtaatctttatacttcagataaagcatgttctttgaacattttttttgtcattattcta

SEQ ID NO: 732 - DNA, 737 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaatggccatggaagcttttcagacagcccttttctaaatagcctggtgggacacatcttgcattcctcaattcttgtgccataccatggatggttagttcatcccggcttttttgtttgtcattggagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaattgtgaaagttataactattaacttttgactaaacttgaaaaaatcacatttttgatgtggaaccaaatctgattttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaagggaatctttatacttcagataaagctgttcttgaacattttttttagtcattatcttagttaaccgag

SEQ ID NO: 733 - DNA, 793 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaatgctggggggtcaagccgtgggcctggcacagcaccggcaacagccgctggaccgtctccagcggccatggaagctttttcagacagccctttttctaaatagcctggtgggacacatcttgcattcctcaattcttgtgccataccatggatggttagttcatcccggcttttttgtttgtcattggaagttcttttattgattcaatttttatagcgtgttcggaaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagtaattagccacagaactcaccatcaaatcatggacacattgagaaggatgaatcctgggttccagtatgtgattaactacttcctctataagttatttttgattcaattaaatttatttatttaataagttcaagaaaaaaggaatctttatacttcagataaagctgttcttgaacattttttttgtcattattc

SEQ ID NO: 734 - DNA, 477 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaacagcaccggcaacagccgctggaccgtctccagcgcctgcttgccaccgccattgctggcgatggccaccacctgctggccatggaagcttttcagacagcccttttctaaatagcctggtgggacacatcttgcatttcctcaattcttgtgccataccatggatggttagttcatcccggctttttgtttgtcattggaagttctttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgag

SEQ ID NO: 735 - DNA, 645 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaccatggaagcttttcagacagcccttttctaaatagcctgtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaattgtgaaagttataactattaacttttgactaaacttgaaaaaatcacattttgatgtggaaccaaatctgatttgagaaccaagttgattttgatggattttgcaggagaattagccacagaactcaccattcaaaatcatggacacattgagaaggatgaatcctgggttccagtatgtgattaactacttcctctatagttattttgattcaattaaattta

SEQ ID NO: 736 - DNA, 551 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaagccatggaagcttttcagacagccctttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttcttttattaattatatttttattgcgtgtttggaatcccattgagaataagaaatcacgtttaaaatgtgaaagttataatctattaacttttgactaaacttgaaaaaatcacattttgaatgtggaaccaaatctgattttgagaaccaagttgaattttgatggattttgcatggagaattagccacaagaactca

SEQ ID NO: 737 - DNA, 734 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaattgtgaaagttataactattaacttttgactaaacttgaaaaaactcacatttttgatgtggaaccaaatctgattttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttattaataagttcaagaaaaaggaatctttatacttcagataaagctgttcttgaacattttttttagtcattatcttagttaaccgag

SEQ ID NO: 738 - DNA, 741 bp, Artificial
  Glycine max FAD3A mutation created with TALEN pair GmFAD3_T01.1
cactgctttgttatgcctacctcatttcatttggctttagacaacttaaatttgagatctttattatgtttttttgcttatatggtaaagtgattcattcttcacattgaattgaaggccatggaagcttttcagacagcccttttctaaatagccggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataactttttagcttcattgtcattgaaaagttctttttattaaattatatttttattgcgtgtttggaatcccatttgagaaataagaaatcacgtttaaaattgtgaaagttataactattaacttttgactaaacttgaaaaaactcacatttttgatgtggaaccaaatctgatttgagaaccaagttgattttgatggattttgccaggagaattagccacagaactcaccatcaaaagtcatggacacattgagaaggatgaatcctgggttccagtatgtgattaactacttcctctatagttattttggtattcaattaaatttatttatttaataagttcaagaaaaaaagggaattctttatacttcagataaagctgtcttgaacattttttttagtcttatcttag

SEQ ID NO: 739 - DNA, 721 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaatttaccgcctttttacggtcacagtggccatggaagcttttcagacagcccttttctaaatagcctggtgggacacatcttgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttc

SEQ ID NO: 740 - DNA, 713 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttattaataagttcaagaaaaaggaatcttatacttcagataaagctgttcttgaacatttttttt

SEQ ID NO: 741 - DNA, 553 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaacaatttttatagcgtgttcggaaacgcgtttcagaaaataatgaaatacatcttgaatctgaaagttataacttttagcttcattgtcattgaaagttcttttattaattatattttttattgcgtgtttggaatcccatttgagaaataagaaatcacgtttaaaatgtgaaagttataactattaacttttgactaaaacttgaaaaaagtcacatttttgatgtggaaccaaatctgatttgagaaccaagttgattttgatggattttgcaggagaattagccacagaactcaccatcaaaaatcatggacacattgagaaggatgaatcctgggttccagtatgtgattaactacttcctctatagttattttgattcaattaaattatttatttaataagttcaagaaaaaaggaatctttatacttcagat

SEQ ID NO: 742 - DNA, 600 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaataagaaatcacgtttaaaatgtgaaagttataactattaacttttgactaaacttgaaaaaactcacatttttgatgtggaaccaaatctgattttgagaaccaagttgattttgatggattttgcaggagaattagccacagaactcaccatcaaaatcatggactacattgagaaaggattgaatcctgggttccagt

SEQ ID NO: 743 - DNA, 477 bp, Artificial
  Glycine max FAD3A mutation created with TALEN pair GmFAD3_T01.1
  misc_feature (264): n is a or c or t or g
cactgctttgttatgcctacctcatttcatttggctttagacaacttaaatttgagatctttattatgttttttgcttatatggtaaagtgattcattcttcacattgaattgaacacctgctggggggtcaagccgtgggcctggcacagcaccggcaacagccgctggaccgtctccagcgcctgcttgccaccgccattgctggcgatggccaccacctgctggggggtcaagccgtgggcctggcacagcaccggggccntggaagcttttcagacagcccttttctaaatagcctggtgggacacatcttgcattcctcaattcttgtgccataccatggatggttagttcatcccggctttttgtttgtcattggaagttcttttattgattcaatttttatagcgtgttcggaacgcgttcagaaataatgaaatacatcttgaatctgaaagttataacttttagcttc

SEQ ID NO: 744 - DNA, 593 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaataagaaatcacgtttaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttcca

SEQ ID NO: 745 - DNA, 746 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgagcgcctgcaccgtctccagcgcctgcttgccaccaatattgctggcgatggccaccacctgctccgggggtcaagccgtgggcctggcacagcaccggcagtggccatggaagcttttcagacagcccttttctaaatagcctggtgggacacatcttgcattcctcaattcttgtgccataccatggatggttagttcatcccggctttttgtttgtcattggaagttcttttattgattcaatttttatagcgtgttcggaaacgcgtttcagaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaactcacatttttgatgtggaaccaaattctgatttgagaaccaagttgattttgatggattttgcaggagaattagccacagaactcaccatcaaaatcatggacacaattgagaagggatgaatcctgggttccagtatgtgattactacttcctctatagttattttttggattcaattaa

SEQ ID NO: 746 - DNA, 740 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaaattgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttattaataagttcaagaaaaagggaatctttatacttcagataaagctgctcttgaacattttttttagtcattatcttagttaaccgag

SEQ ID NO: 747 - DNA, 824 bp, Artificial
  Glycine max FAD3A mutation created with TALEN pair GmFAD3_T01.1
cactgctttgttatgcctacctcatttcatttggctttagacaacttaaatttgagatctttattatgtttttttgcttatatggtaaagtgattcattcttcacattgaattgaacttgccaccgccattgctggcgatggccaccacctgctggggggtcaagccgtgggcctggcacagcaccggcagtggccatggaagctttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggtttccagtatgtgattaactacttcctctatagttatttttgattcaattaaatttatttatttaataagttcaagaaaaaagggaatctttatacttcagataaagctgttctttgaacatttttttttagtcattatttctagtttaaccgagaa

SEQ ID NO: 748 - DNA, 634 bp, Artificial
  Glycine max FAD3A mutation created with TALEN pair GmFAD3_T01.1
cactgctttgttatgcctacctcatttcatttggctttagacaacttaaatttgagatctttattatgtttttttgcttatatggtaaagtgattcattcttcacattgaattgaaaaggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcatttgtcattgaaagttctttttattaattatatttttattgcgtgtttggaatcccatttgagaaattaagaaatcacgtttaaaattgtgaaagttataactattaacttttgactaaacttgaaaaaactcacatttttgatgtggaaccaaatctgattttgagaaccaagttgaattttgatggattttgcatggagaattagccacagaactcaccatcaaaatcatggacacattgagaaggattgaatcctgggttccagtatgtgattaactacttcctctatag

SEQ ID NO: 749 - DNA, 690 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgagcaggcgctggagacggtccagcggctgttgccggtgctgtgccaggcccacggcttgaccccccagcaggtggtggccatcgccaccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgtgtgtttggaatcccatttgagaaataagaaatcacgtttaaaatgtgaaagttataactattaacttttgactaaacttgaaaaaaatcacatttttgatgtggaaccaaatctgatttgagaaccaagttgattttgatggattttgcaggagaattagccacagaactcaccatcaaaatcatggacacattgagaagggatgaatcctgggttccagtatgtgatt

SEQ ID NO: 750 - DNA, 677 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatttcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttcttttattaattatatttttattgcgtgtttggaatccatttgagaaataagaaatcacgtttaaaatgtgaaagttataactattaacttttgactaaacttgaaaaaattcacatttttgatgtggaaccaaatctgattgagaaccaagttgattttgatggattttgcaggagaattagccacagaactcaccatcaaaaatcatggacacattgagaaggatgaatcctgggttccagtatgtgattaactacttcctctatagttatttttgattcaattaaatttatttatttaataagttcaagaaaaaatggaatctttatacttcagataaagctgttacttgaacatttttttt

SEQ ID NO: 751 - DNA, 480 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaacacctgctggggggtcaagccgtgggcctggcacagcaccggcaacagccgctggaccgtctccagcgcctgcttgccaccgccattgctggcgatggccaccacctgctggggggtcaagccgtgggcctggcacagcaccggggccatggaagcttttcagacagcccttttctaaatagcctggtgggacacatcttgcattcctcaaattctttgtgccataccatggatggttagttcatcccggctttttgtttgtcattggaagttcttttattgattcaatttttatagcgtgttcggaaacgcgttcagaaaataatgaaatacatcttgaatctgaaagttataacttttagctt

SEQ ID NO: 752 - DNA, 699 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttataattatattttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagtattttgattcaattaaatttatttattaataagttcaagaaaaaggaatcttatacttcagataaagctgttcttgaacatttttttt

SEQ ID NO: 753 - DNA, 596 bp, Artificial
  Glycine max FAD3A mutation created with TALEN pair GmFAD3_T01.1
cactgctttgttatgcctacctcatttcatttggctttagtacaacttaaatttgagaattctttattatgttttttgcttatatggtaaagtgattcattcttcacattgagaggcagggtcggaacaggagagcgcacggagggagcttgccagggggaaacgcctggtatctttatagtcctgtcgggtttcgccagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaactttgactaaacttgaaaaaaatcacattttgatgtggaaccaaatctgatttgagaaccaagttga

SEQ ID NO: 754 - DNA, 723 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaattgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttattatttaataagttcaagaaaaaagggaatctttatacttcagataaagctgttcttgaacattttttttagtcattatcttag

SEQ ID NO: 755 - DNA, 741 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaaattgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaagggaatctttatacttcagataaagctgttcttgaacattttttttagtcattatcttagttaaccgag

SEQ ID NO: 756 - DNA, 724 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaatagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttattaataagttcaagaaaaaggaatctttatacttcagataaagctgttcttgaacattttttttagtcattatcttagttaaccgag

SEQ ID NO: 757 - DNA, 708 bp, Artificial
  Glycine max FAD3A mutation created with TALEN pair GmFAD3_T01.1
cactgctttgttatgcctacctcatttcatttggctttagacaacttaaatttgagatctttattatgtttttttgcttatatggtaaagtgattcattcttcacattgaattgaaccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataactttttagcttcattgtcattgaaaagttctttttattaattatatttttattgcgtgtttggaatcccatttgagaaataagaaatcacgttttaaaaattgtgaaagttataactattaacttttgactaaacttgaaaaaatcacatttttgatgtggaaccaaatctgatttgagaaccaagttgattttgatggattttgcaggagaattagccacagaactcaccatcaaaaatcatggacacattgagaaggatgaatcctgggttccagtatgtgattaactacttcctctatagttatttttgattcaattaaatttatttatttaataagttcaagaaaaaagggaatctttatacttcagataaagctgttc

SEQ ID NO: 758 - DNA, 729 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatattttattgcgtgtttggaatcccatttgagaaataagaaatcacgtttaaaattgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttattaataagttcaagaaaaaggaatctttatacttcagataaagctgttcttgaacatttttttagtcattatcttagttaaccgag

SEQ ID NO: 759 - DNA, 713 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaaattgtgaaagttataactattaacttttgactaaacttgaaaaaatcacatttttgatgtggaaccaaatctgattttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttattaataagttcaagaaaaaggaatctttatacttcagataaagctgttcttgaacattttttt

SEQ ID NO: 760 - DNA, 634 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaaattgtgaaagttataactattaacttttgactaaacttgaaaaaactcacatttttgatgtggaaccaaatctgatttgagaaccaagttgatttgatggattttgcaggagaattagccacagaactcaccatcaaaatcatggacacattgagaaggatgaatcctgggttccagtatgtgattaactacttcctctatagttattttt

SEQ ID NO: 761 - DNA, 642 bp, Artificial
  Glycine max FAD3A mutation created with TALEN pair GmFAD3_T01.1
cactgctttgttatgcctacctcatttcatttggctttagacaacttaaatttgagatctttattatgtttttttgcttatatggtaaagtgattcattcttcacattgaattgagccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaaattgtgaaagttataactattaacttttgactaaacttgaaaaaactcacattttttggattgtggaaccaaaatctgattttgagaaccaagttgattttgatggattttgccaggagaattagccacagaactcaccatcaaaatcatggacacattgagaaggatgaatcctgggttccagtatgtgattaactacttcctctatagttatttttgg

SEQ ID NO: 762 - DNA, 740 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaatggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaaggaatctttatacttcagataaagctgttcttgaacattttttttgtcattatcttagttaaccgag

SEQ ID NO: 763 - DNA, 694 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttattaataagttcaagaaaaaggaatcttatacttcagataaagctg

SEQ ID NO: 764 - DNA, 728 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatattttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttattaataagttcaagaaaaaggaatcttatacttcagataaagctgttcttgaacatttttttgtcattatcttagttaaccgag

SEQ ID NO: 765 - DNA, 740 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaccatggaagctttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgattttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaaggaatctttatacttcagataaagctgttcttgaacattttttttgtcattatcttagttaaccgag

SEQ ID NO: 766 - DNA, 702 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaaatgtgaaagttataactattaacttttgactaaacttgaaaaaatcacatttttgatgtggaaccaaatctgatttgagaaccaagtttgattttgatggattttgcaggagaattagccacagaactcaccatcaaaatcatggacacattgagaaggatgaatcctgggttccagtatgtgattaactacttcctctatagttatttttgattcaattaaaatttatttatttaataagttcaagaaaaaaggaatctttatacttcagataaagctg

SEQ ID NO: 767 - DNA, 740 bp, Artificial
  Glycine max FAD3A mutation created with TALEN pair GmFAD3_T01.1
cactgctttgttatgcctacctcatttcatttggctttagacaacttaaatttgagatctttattatgtttttttgcttatatggtaaagtgattcattcttcacattgaattgaccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaaattgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttattaataagttcaagaaaaagggaatctttatacttcagataaagctgttcttgaacattttttttagtcattatcttagttaaccgag

SEQ ID NO: 768 - DNA, 740 bp, Artificial
  Glycine max FAD3A mutation created with TALEN pair GmFAD3_T01.1
  misc_feature (619): n is a or c or t or g
cactgctttgttatgcctacctcatttcatttggctttagacaacttaaatttgagatctttattatgtttttttgcttatatggtaaagtgattcattcttcacattgaattggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaattgtgaaagttataactattaacttttgactaaacttgaaaaaatcacatttttgatgtggaaccaaatctgatttgagaaccaagttgattttgatggattttgcaggagaattagccacaagaactcacctcaaaatcatggacacattgagaaggatgaatcctgggttccagtatgtgattaactacttcctcnatagttatttttgattcaattaaaatttatttattaataagttcaagaaaaaagggaatcttatacttcagataaagctgttcttgaacattttttttagtcattatcttagttaaccgag

SEQ ID NO: 769 - DNA, 787 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaaccctgagtcattaatatgtgacgcaccaagcccaccaaagcagtggccatggaagcttttcagacagcccttttctaaatagcctggtgggacacatcttgcattcctcaattcttgtgccataccatggatggttagttcatcccggctttttttgtttgtcattggaagttcttttattgattcaatttttatagcgtgttcggaaacgcgtttcagaaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttattttaataagttcaagaaaaaggaatcttttatacttcagataaagctgttcttgaacattttttttgtcattatcttagtttaaccga

SEQ ID NO: 770 - DNA, 702 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattctttggccatggaagcttttcagacagcccttttctaaatagcctggtgggacacatcttgcattcctcaattcttgtgccataccatggatggttagttcatcccggcttttttgtttgtcattgggaagttcttttattgattcaatttttatagcgtgttcggaaacgcgtttcagaaataatgaaatacatcttgaatctgaaagttataacttttagcttcattgtcattgaaagttcttttattaattatatttttattgcgtgtttggaatcccatttgagaaataagaaatcacgtttaaaatgtgaagttataactattaacttttgactaaacttgaaaaaatcacatttttgatgtggaaccaaatctgatttgagaaccaagttgattttgatggattttgcaggagaattagccacagaactcaccatcaaaaatcatggacacattgagaaggatgaatcctgggttccagtatgtgattaactacttcctctatagttatttttgattcaattaaatttatttatttaataagttcaagaaaaaaggaatctttatacttcagataaagctgttcttgaacattttttt

SEQ ID NO: 771 - DNA, 744 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgatggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaaatgtgaaagttataactattaacttttgactaaacttgaaaaaatcacatttttgatgtggaaccaaatctgatttgagaaccaagttgattttgatggattttgcaggagaattagccacaagaactcaccatcaaaatcatggacacattgagaaggatgaatcctgggttccagtatgtgattaacatacttcctcctatagttattttgattcaattaaatttatttatttaataagttcaagaaaaaaagggaatctttatacttcagataaagctgttcttgaacattttttttgtcattatcttagttaaccgag

SEQ ID NO: 772 - DNA, 617 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaagccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaataatgaaatacatcttgaatctgaaagttataaacttttagcttcattgtcattgaaaagttctttttattaattatatttttattgcgtgtttggaatcccatttgagaaataagaaatcacgttttaaaatgtgaaagttataactattaacttttgactaaacttgaaaaaatcacatttttgatgtggaaccaaatctgattttgagaaccaagttgaattttgatggattttgcaggagaattagccacagaactcaccatcaaaatcatggacacattgagaaggatgaatcctgggttccagtatgtgattaactactt

SEQ ID NO: 773 - DNA, 740 bp, Artificial
  Glycine max FAD3A mutation created with TALEN pair GmFAD3_T01.1
  misc_feature (680): n is a or c or t or g
cactgctttgttatgcctacctcatttcatttggctttagacaacttaaatttgagatctttattatgttttttgcttatatggtaaagtgattcattcttcacattgaattgaaccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcatttgtcattgaaaagttctttttattaattatattttattgcgtgtttggaatcccatttgagaaataagaaatcacgtttaaaattgtgaaagttataactattaacttttgactaaacttgaaaaaactcacatttttgatgtggaaccaaatctgatttgagaaccaagttgatttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaagggaatcttntacttcagataaagctgttcttgaacatttttttagtcattatcttagttaaccgagaag

SEQ ID NO: 774 - DNA, 709 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaaatcatggacacattgagaaggatgaatcctgggttccagtatgtgattaactacttcctctatagttatttttgattcaattaaatttattatttaataagttcaagaaaaaaggaatctttatacttcagataaagctgttcttgaacattttttttgtcattatcttagttaaccgagaa

SEQ ID NO: 775 - DNA, 699 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaaattgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaaagggaatctttatacttcagataaagctg

SEQ ID NO: 776 - DNA, 645 bp, Artificial
  Glycine max FAD3A mutation created with TALEN pair GmFAD3_T01.1
cactgctttgttatgcctacctcatttcatttggctttagatcaacttaaatttgagatctttattatgttttttgcttatatggtaaagtgattcattcttcacattgaattgaaggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttctttttattaaattatatttttcattgcgtgtttggaaatcccatttgagaaataagaaatcacgtttaaaaattgtgaaagttataactattaacttttgactaaacttgaaaaaactcacatttttggatgtggaaccaaaatctgatttgagaaccaagttgattttgatggattttgcaggagaattagccacagaactcaccatcaaaatcatggacacattgagaaggattgaatcctgggttccagtatgtgattaactacttcctctatagttatttttgg

SEQ ID NO: 777 - DNA, 714 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataactttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttattaataagttcaagaaaaaggaatctttatacttcagataaagctgttcttgaacatttttttt

SEQ ID NO: 778 - DNA, 727 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaaggaatctttatacttcagataaagctgttcttgaacatttttttgtcattatcttagttaa

SEQ ID NO: 779 - DNA, 743 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttctttttattaattatatttttattgcgtgtttggaatcccatttgagaaataagaaatcacgtttaaaaattgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttattaataagttcaagaaaaaggaatcttatacttcagataaagctgttcttgaacatttttttagtcattatcttagttaaccgagaag

SEQ ID NO: 780 - DNA, 734 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaatggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttattaataagttcaagaaaaaaggaatctttatacttcagataaagctgttcttgaacattttttttgtcattatcttagttaaccgag

SEQ ID NO: 781 - DNA, 736 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgatggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttattaataagttcaagaaaaaggaatctttatacttcagataaagctgttcttgaacatttttttgtcattatcttagttaaccgag

SEQ ID NO: 782 - DNA, 625 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataactttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggattccagtatgtgattaactacttcctctatagtta

SEQ ID NO: 783 - DNA, 703 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacatggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatattttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttattaataagttcaagaaaaaggaatcttatacttcagataaagctgttcttgaacatttttttt

SEQ ID NO: 784 - DNA, 696 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaatggccatggaagcttttcagacagcccttttctaaatagcctggtgggacacatcttgcattcctcaattcttgtgccataccatggatggttagttcatcccggctttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgattttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttattaataagttcaagaaaaaaggaatctttatacttcagataaagctg

SEQ ID NO: 785 - DNA, 627 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgatggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatattttattgcgtgtttggaatcccatttgagaaataagaaatcacgtttaaaatgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggattgaatcctgggttccagtatgtgattaactacttcctctatagtta

SEQ ID NO: 786 - DNA, 728 bp, Artificial
  Glycine max FAD3A mutation created with TALEN pair GmFAD3_T01.1
  misc_feature (648); (677): n is a or c or t or g
cactgctttgttatgcctacctcatttcatttggctttagacaacttaaatttgagatctttattatgttttttgcttatatggtaaagtgattcattcttcacattgaattgatgccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatattttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttnttaataagttcagaaaaaaggaatctttntactcagataaagctgtcttgaacatttttttgtcttatcttagaaccgag

SEQ ID NO: 787 - DNA, 616 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacgtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaattgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatag

SEQ ID NO: 788 - DNA, 712 bp, Artificial
  Glycine max FAD3A mutation created with TALEN pair GmFAD3_T01.1
cactgctttgttatgcctacctcatttcatttggctttagacaacttaaatttgagatctttattatgtttttgttcttatatggtaaagtgattcattcttcacattgaattgccagcaatattggtctggggggtcaagccgtgggcctggcacagcaccggcaacagccgctggaccgtctccagcgcctgcttgccaccgtggccatggaagcttttcagacagcccttttctaaatagcctggtgggacacatcttgcattcctcaattcttgtgccataccatggatggttagttcatcccggcttttttgttttgtcattggaagttcttttattgattcaatttttatagcgtgttcggaaacgcgtttcagaaataatgaaatacatcttgaatctgaaagttataacttttagcttcattgtcattgaaagttcttttattaattatatttttattgcgtgtttggaatcccatttgagaaataagaatcacgtttaaaatgtgaaagttataactattaacttttgactaaacttgaaaaaaactcacatttttgatgtggaaccaaatctgatttgagaaccaagttgattttgatggattttgcagagaattagccacagaactcaccatcaaaatcatggacacattgagaagggatgaatcctgggttccagtatgtgattactacttcctctatag

SEQ ID NO: 789 - DNA, 635 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaattgtgaaagttataactattaacttttgactaaacttgaaaaaactcacatttttgatgtggaaccaaatctgtttgagaaccaagttgattttgatggattttgcaggagaattagccacagaactcaccatcaaaatcatggacacattgagaaggatgaatcctgggttccagtatgtgattaactacttcctctatagttatttttgattc

SEQ ID NO: 790 - DNA, 717 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgatggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacatttttttt

SEQ ID NO: 791 - DNA, 716 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaataatgaaatacatcttgaatctgaaagttataacttttagcttcattgtcattgaaaagttcttttattaattatatttttattgcgtgtttggaatcccatttgagaaataagaaatcacgtttaaaatgtgaaagttataactattaactttgactaaacttgaaaaaatcacattttgatgtggaaccaaatctgatttgagaaccaagttgatttttgatggattttgcaggagaattagccacagaactcaccatcaaaaatcatggacacattgagaaggatgaatcctgggttccagtatgtgattaactacttcctctatagttattttgattcaattaaatttattatttaataagttcaagaaaaaaggaatctttatacttcagataaagctgttcttgaacatttttttgtcattatcttagttaacc

SEQ ID NO: 792 - DNA, 625 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatattttattgcgtgtttggaatcccatttgagaaataagaaatcacgtttaaaaattgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagtta

SEQ ID NO: 793 - DNA, 663 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacatcatggaagcttttcagacagcccttttctaaatagcctggtgggacacatctgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatattttattgcgtgtttggaatcccatttgagaaataagaaatcacgtttaaaaatgtgaaagttataactattaacttttgactaaacttgaaaaaatcacatttttgatgtggaaccaaatctgatttgagaaccaagttgaattttgatggattttgcaggagaattagccacagaactcaccatcaaaatcatggacacattgagaaggatgaatcctgggttccagtatgtgattaactacttcctctatagttattttgattcaattaaatttatttattaataagttcaagaaaaaaggaatc

SEQ ID NO: 794 - DNA, 730 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacatcatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaaatcatggacacattgagaaggatgaatcctgggttccagtatgtgattaactacttcctctatagttattttgattcaattaaatttatttatttaataagttcaagaaaaaagggaatctttatacttcagataaagctgttcttgaacattttttttagtcattatcttagttaaccgag

SEQ ID NO: 795 - DNA, 733 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatattttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaaggaatctttatacttcagataaagctgttcttgaacattttttttgtcattatcttagttaaccgag

SEQ ID NO: 796 - DNA, 745 bp, Artificial
  Glycine max FAD3A mutation created with TALEN pair GmFAD3_T01.1
cactgctttgttatgcctacctcatttcatttggctttagacaacttaaatttgagatctttattatgtttttttgcttatatggtaaagtgattcattcttcacattgaattgaccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaattgtgaaagttataactattaacttttgactaaacttgaaaaaactcacattttttggatgtggaaccaaaatctgattttgagaaccaagttgattttgatggattttgccaggagaattagccacagaactcaccatcaaaaatcatggacacattgagaaggatgaatcctgggttccagtatgtgattaactacttcctctatagttatttttgattcaattaaatttattatttaataagttcaagaaaaagggaatcttatacttcagataaagctgttcttgaacattttttttagtcattatcttagttaaccgag

SEQ ID NO: 797 - DNA, 745 bp, Artificial
  Glycine max FAD3A mutation created with TALEN pair GmFAD3_T01.1
cactgctttgttatgcctacctcatttcatttggctttagacaacttaaatttgagatctttattatgtttttttgcttatatggtaaagtgattcattcttcacattgaattgaaggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaaattgtgaaagttataactattaacttttgactaaacttgaaaaaatcacatttttgatgtggaaccaaatctgattttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaagggaatctttatacttcagataaagctgttcttgaacattttttttagtcattatcttagttaaccgag

SEQ ID NO: 798 - DNA, 741 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaacaggcggtgctacagagttcttgaagtggtggcctaactacggctacactagaagaacagtaaatggaagcttttcagacagcccttttctaaatagcctggtgggacacatcttgcattcctcaattcttgtgccataccatggatggttagttcatcccggctttttgtttgtcattggaagttcttttattgattcaatttttatagcgtgttcggaaacgcgtttcagaaaataatgaaatacatcttgaatctgaaagttataacttttagcttcattgtcattgaaagttctttattaattatattttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaaggaatctttatactt

SEQ ID NO: 799 - DNA, 506 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaatggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcatttgtcattgaaaagtttcttttattaattatatttttatttgcgtgtttggaatcccatttgagaaattaagaaatcatcgtttaaaaatgtgaaagttactaactattaacttttgactaaaacttgaaaaaatcacatttttgatgtggtaaccaaatctgattttgag

SEQ ID NO: 800 - DNA, 518 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaatggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttcttttattaattatatttttattgcgtgtttggaatcccatttgagaaataagaaatcacgtttaaaattgtgaaagttataactattaacttttgactaaacttgaaaaaactcacatttttgatgtggaaccaaatctgatttgagaaccaagttgatttgatgga

SEQ ID NO: 801 - DNA, 611 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgagcaggcgctggagacggtccagcggctgttgccggtgctgtgccaggcccacggcttgaccccccagcaggtggtggccatcgccaccatcggaagctttacatgacagccccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataactttagcttcattgtcattgaaagttctttattaattatattttattgtgtgtttggaatcccatttgagaaataagaaatcacgtttaaaagtgtgaaagttataactattaacttttgactaaacttgaaaaaaactcacatttttgatgtggaaccaaaatctgatttgagaaccaagttgattttgatggatttt

SEQ ID NO: 802 - DNA, 626 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaatggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaaatgtgaaagttataactattaacttttgactaaacttgaaaaaatcacatttttgatgtggaaccaaatctgattttgagaaccaagttgaatttgatggattttgcaggagaattagccacagaactcaccatcaaaaatcatggacacattgagaaggatgaatcctgggttccagtatgtgattaactacttcctctatagtta

SEQ ID NO: 803 - DNA, 635 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattcatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaattgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggattgaatcctgggttccagtatgtgattaactacttcctctatagttatttttgattcaa

SEQ ID NO: 804 - DNA, 674 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaacagtgtgaaataccgcacagatgcgtaaggagaaaataccgcatcaggcgccattcgccattcaggctgcgcaactgttgggaagggcgatcggtgcgggcctcttggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaatcacattttgatgtggaaccaaatctgatttgagaaccaagttgattttgatggattttgcaggagaattagccacagaactcaccatcaaaatcatggacac

SEQ ID NO: 805 - DNA, 723 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgattttgacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaataatgaaatacatcttgaatctgaaagttataacttttagcttcattgtcattgaaaagttcttttattaattatatttttattgcgtgtttggaatcccatttgagaaaataagaaatcactgatttaaatgtagaagttataactattaacttttgactaaactttgaaaaaatcacattttgatgtggaaccaaatctgatttgagaaccaagttgattttgatggattttgcaggagaattagccacagaactcaccatcaaaaatcatggacacattgagaaggatgaatcctgggttccagtatgtgattaactacttcctctatagttatttttgattcaattaaatttatttatttaataagttcaagaaaaaaggaatctttatacttcagataaagctgttcttgaacattttttttgtcattatcttagttaaccgagaa

SEQ ID NO: 806 - DNA, 714 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaggccatggaagctttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttattaataagttcaagaaaaaaggaatctttatacttcagataaagctgttcttgaacatttttttt

SEQ ID NO: 807 - DNA, 734 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatattttattgcgtgtttggaatcccatttgagaataagaaatcacgtttaaattgtgaaagttataactattaacttttgactaaacttgaaaaaactcacattttttgatgtggaaccaaatctgattttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttattatagttcaagaaaagggaatctttatacttcagataaagctgtcttgaacattttttttagtcattatcttagttaaccgag

SEQ ID NO: 808 - DNA, 661 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaacagacagtggccatggaagcttttcagacagcccttttctaaatagcctggtgggacacatcttgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagtatttttgattcaattaaatttatttattt

SEQ ID NO: 809 - DNA, 752 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcaattcttgtgcgccgggtgttggcttaacgctgccgggtgttggcttaacgcaacgatgtgcgcgtgtgtaaaccagtggccatggaagctttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaatcacattttgatgtggaaccaaatctgatttgagaaccaagttgattttgatggattttgcaggagaattagccacagaactcaccatcaaaatcatggacacatttgagaaggatgaatcctgggttccagtatgtgattaactacttcctctatagttatttttgattcaattaaatttatttatttaataagttcaagaaaaaggaatctttatacttca

SEQ ID NO: 810 - DNA, 646 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgatccctttttcactgcatccagcgcaggacgcccgccgaggcaggccaaggcgacgaggtggtcgttggtcaacgcggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatgggattttgcaggagaatttagccacagaactcaccatcaaaatcatggacac

SEQ ID NO: 811 - DNA, 696 bp, Artificial
  Glycine max FAD3A mutation created with TALEN pair GmFAD3_T01.1
cactgctttgttatgcctacctcatttcatttggctttagacaacttaaatttgagatctttattatgtttttttgcttatatggtaaagtgattcattcttcacattgaattgtggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatattttattgcgtgtttggaatcccatttgagaaataagaaatcacgtttaaaatgtgaaagttataactattaacttttgactaaacttgaaaaaatcacatttttgatgtggaaccaaatctgattttgagaaccaagttgattttgatggattttgcatggagaattagccacagaactcaccatcaaaatcatggacacattgagaaggatgaatcctgggttccagtatgtgattaactacttcctctatagttatttttgattcaattaaatttatttatttaataagttcaagaaaaaagggaatctttatacttcagataaagctg

SEQ ID NO: 812 - DNA, 709 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatattttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaagggaatctttatacttcagataaagctgttcttgaacattttttt

SEQ ID NO: 813 - DNA, 719 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgcttcatttgttatccatggaagcttttcagacagcccttttctaaatagcctggtgggacacatcttgcattcctcaattcttgtgccataccatggatggttagttcatcccggcttttttgtttgtcattgggaagttcttttattgattcaatttttatagcgtgttcggaaacgcgtttcagaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaaatcatggacacattgagaaggatgaatcctgggttccagtatgtgattaactacttcctctatagttattttgattcaattaaatttatttatttaataagttcaagaaaaaggaatctttatacttcagataaagctgttcttgaacattttttttgtcattatcttagttaa

SEQ ID NO: 814 - DNA, 661 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaggcgcagaatgaccataatttgtctctgcgtgccatcggacacgatcgggcctggatggaaaggcgcagaatgaccataatttgtctttgcgtcatggaagcttttcagacagcccttttctaaatagcctggtgggacacatcttgcattcctcaattcttgtgccataccatggatggttagttcatcccggcttttttgttttgtcattggaagttcttttattgattcaatttttatagcgtgttcggaaacgcgtttcagaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaactcacatttttgatgtggaaccaaattctgatttgagaaccaagttgattttgatggattttgcaggagaattagccacagaactcaccatcaaaatcatggacac

SEQ ID NO: 815 - DNA, 686 bp, Artificial
  Glycine max FAD3A mutation created with TALEN pair GmFAD3_T01.1
cactgctttgttatgcctacctcatttcatttggctttagacaacttaaatttgagatctttattatgtttttttgcttatatggtaaagtgattcattcttcacattgaattgaagccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaaggatgaatcctgggttccagtatgtgattaactacttcctctatagttattttgattcaattaaatttatttattaataagttcaagaaaaaaggaatctttatac

SEQ ID NO: 816 - DNA, 724 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattcatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatattttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaaggaatctttatacttcagataaagctgattcttgaacatttttttgtcattatcttagttaaccgag

SEQ ID NO: 817 - DNA, 672 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaactgcgtttcagaaaataatgaaatacatcttgaatctgaaagttataacttttagcttcattgtcattgaaagttcttttattaattatatttttattgcgtgtttggaatcccatttgagaaaataagaaatcacgtttaaaatgtgaagttataactattaacttttgactaaacttgaaaaaatcacattttgatgtggaaccaaatctgatttgagaaccaagttgattttgatggattttgcaggagaattagaccacagaacttcaccatcaaaaatcatggacacattgagaaggatgaatcctgggttccagtatgtgattaactacttcctctatagttattttgattcaattaaatttattatttaataagttcaagaaaaaggaatctttatacttcagataaagctgtt

SEQ ID NO: 818 - DNA, 732 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttcttttattaattatatttttattgcgtgtttggaatcccatttgagaaataagaaatcacgtttaaaaatgtgaaagttataactattaacttttgactaaacttgaaaaaatcacatttttgatgtggaaccaaatctgattttgagaaccaagttgattttgatggattttgcaggagaattagccacagaactcaccatcaaaatcatggacacattgagaaggatgaatcctgggttccagtatgtgattaactacttcctctatagttattttgattcaattaaatttattattaataagttcaagaaaaaggaatcttatacttcagataaagctgattcttgaacatttttttgtcattatcttagttaaccgag

SEQ ID NO: 819 - DNA, 769 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaacaggcccacggcttgaccccggagcaggtggtggccatcgccagccacgatggcggcaagcaggcgctggagacggtccagcggctatggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaaacgcgtttcagaaaataatgaaatacatcttgaatctgaaagttataacttttagcttcattgtcattgaaagttcttttattaattatattttattgcgtgtttggaatcccattgagaaataagaaatcacgtttaaatgtgaaagttataactattaactttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatactt

SEQ ID NO: 820 - DNA, 572 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgcttcatttgttatccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgttttcagaaaataatgaaatacatcttgaatctgaaagttataacttttagcttcattgtcattgaaaagttctttttattaattatatttttattgcgtgtttggaatcccatttgagaaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaacttcaccatcaaaaatcatggacacatttgagaagga

SEQ ID NO: 821 - DNA, 719 bp, Artificial
  Glycine max FAD3A mutation created with TALEN pair GmFAD3_T01.1
  misc_feature (676): n is a or c or t or g
cactgctttgttatgcctacctcatttcatttggctttagacaacttaaatttgagatctttattatgttttttgcttatatggtaaagtgattcattcttcacattgaattggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttattaataagtcagaaaaaagggaatctttntacttcagataaagctgttcttgaacattttttttgtcttatc

SEQ ID NO: 822 - DNA, 655 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgatggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaataagaaatcacgtttaaaaattgtgaaagttataactattaacttttgactaaacttgaaaaaatcacatttttgatgtggaaccaaatctgattttgagaaccaagtttgattttgatggattttgcaggagaattagccacagaactcaccattcaaaatcatggacacattgagaaggattgaatcctgggttccagtatgtgattaactacttcctctatagttatttttgattcaattaaatttattt

SEQ ID NO: 823 - DNA, 828 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaatcaccggcaacagccgctggaccgtctccagcgcctgcttgccgccatcgtggctggcgatggccaccacctgctccggggtcaatggccatggaagcttttcagacagcccttttctaaatagcctggtgggacacatcttgcattcctcaattcttgtgccataccatggatggttagttcatcccggcttttttgtttgtcattggaagttctttttattgattcaatttttatagcgtgttcggaaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaattcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttattttatttcaataagttcaagaaaaacggaatctttatactttcagataaagctgttcttgaacattttttttcgtcattatcttagtaaccgagaag

SEQ ID NO: 824 - DNA, 735 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaatggccatggaagcttttcagacagaccttttctaaatagcctggtgggacacatcttgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaatttaaatttattttattttaaataaagtttcaagaaaaaaggaatctttatacttcagataaagctgttcttgaacattttttttgtcattatctt

SEQ ID NO: 825 - DNA, 696 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaagccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgatcaattaaatttatttattaataagttcaagaaaaaggaatctttatacttcagataaagctg

SEQ ID NO: 826 - DNA, 738 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaccatggaagcttttcagacagcccttttctaaaatagcctggtgggacacatcttgcattcctcaattcttgtgccataccatggatggttagttcatcccggctttttttgtttgtcattggaagttcttttattgattcaattttatagcgtgttcggaaacgcgtttcagaaaataatgaaatacatcttgaatctgaaaagttataacttttagcttcattgtcattgaaaagttctttttatttaaattatatttttattgcgtgtttggaatcccatttgagaaataagaaatcacgtttaaaaattgtgaaagttataactattaacttttgactaaacttgaaaaaactcacatttttgatgtggaaccaaatctgatttgagaaccaagttgattttgatggattttgcaggagaattagccacagaactcaccatcaaaaatcatggacacattgagaaggatgaatcctgggttccagtatgtgattaactacttcctctatagttattttgattcaattaaatttatttatttaataagttcaagaaaaaaagggaatctttatacttcagataaagctgttcttgaacattttttttagtcattatcttag

SEQ ID NO: 827 - DNA, 563 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgactggtgggacacatcttgcattcctcaattcttgtgccataccatggatcgttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttcttttattaattatatttttattgcgtgtttggaatcccatttgagaaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtg

SEQ ID NO: 828 - DNA, 813 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaatcaccggcaacagccgctggaccgtctccagcgcctgcttgccgccatcgtggctggcgatggccaccacctgctccggggtcaatggccatggaagcttttcagacagcccttttctaaatagcctggtgggacacatcttgcattcctcaattcttgtgccataccatggatggttagttcatcccggcttttttgtttgtcattggaagttctttttattgattcaatttttatagcgtgttcggaaaacgcgtttcagaaaaataatgaaatacatcttgaatctgaaagttataacttttagcttcattgtcattgaaagttcttttattaattatattttattgcgtgtttggaatcccatttgagaaataagaaatcacgtttaaatgtgaaagttataactattaacttttgactaaacttgaaaaaattcacatttttgatgtggaaccaaatctgatttgagaaccaaagttgattttgatggattttgcaggagaattagccacagaactcaccatcaaaatcatggacacattgagaaggatgaatcctgggttccagtaatgtgattaactacttcctctatagttatttttgattcaattaaatttatttatttaataagttcaagaaaaaggaatctttatactttcagataaagtctgttcttgaacatttttttgtcattatctta

SEQ ID NO: 829 - DNA, 708 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaacagcaccggcaacagccgctggaccgtctccagcgcctgcttgccaccgccattgctggcgatggccaccacctgctggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaatgtgaaagttataactattaacttttgactaaacttgaaaaaaagtcacatttttgatgtggaaccaaatctgatttgagaaccagttgattttgatgggattttgcaggagtaattagccacagaactcaccatcaaatcatggacacattgagaaggatgaatcctgggttccagtatgtgattaactacttcctctatagttattttt

SEQ ID NO: 830 - DNA, 724 bp, Artificial
  Glycine max FAD3A mutation created with TALEN pair GmFAD3_T01.1
cactgctttgttatgcctacctcatttcatttggctttagacaacttaaatttgagatctttattatgtttttttgcttatatggtaaagtgattcattcttcacattgaattgagccccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaaattgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaagggaatctttatacttcagataaagctgttcttgaacattttttttagtc

SEQ ID NO: 831 - DNA, 595 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgatttcatttggctttgttatgccggtgctgtgccaggccatggaagtcttttcagctacagacccttttctaaatagcctggtgggacacatcttgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaaattgtagtaaatgattcattaactttattaacttttgaactaactgaaaaaaatcacatttttgatgtggaaccaaatctgatttgagaaccaagttgattttgatggattttgcaggagaattagccacagaactcaccatcaaaatcatggacac

SEQ ID NO: 832 - DNA, 548 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcacca

SEQ ID NO: 833 - DNA, 696 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatattttattgcgtgtttggaatcccatttgagaaataagaaatcacgtttaaaaatgtgaaagttataactattaacttttgactaaacttgaaaaaatcacatttttgatgtggaaccaaatctgattttgagaaccaagttgaattttgatggattttgcaggagaattagccacagaactcaccatcaaaatcatggacacattgagaaggatgaatcctgggttccagtatgtgattaactacttcctctatagttatttttgattcaattaaaatttatttatttaataagttcaagaaaaaaaggaatctttatacttcagataaagc

SEQ ID NO: 834 - DNA, 710 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattcatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaaggaatctttatacttcagataaagctgttcttgaacattttttt

SEQ ID NO: 835 - DNA, 516 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcatttgtcattgaaaagttcttttattaattatattttattgcgtgtttggaatcccatttgagaaattaagaaatcacgttttaaaaatgtgaaagttataactattaacttttgactaaaacttgaaaaaacttcaacatttttgatgtggaaccaaatctgattttgagaaccaagttgaa

SEQ ID NO: 836 - DNA, 737 bp, Artificial
  Glycine max FAD3A mutation created with TALEN pair GmFAD3_T01.1
  misc_feature (398): n is a or c or t or g
cactgctttgttatgcctacctcatttcatttggctttagacaacttaaatttgagatctttattatgttttttgcttatatggtaaagtgattcattcttcacattgaattgccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttatttaattatatttttatttgcggtttggaaatcccatttgngaaataagaaatcacgtttaaaaatgtgaaagttataactattaacttttgactaaaacttgaaaaaatcacatttttgatgtggaaccaaatctgtttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttattaataagttcaagaaaaaaggaatcttatacttcagataaagctgttcttgaacattttttttgtcattatcttagttaaccgag

SEQ ID NO: 837 - DNA, 633 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaatggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatattttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgatcaattaa

SEQ ID NO: 838 - DNA, 672 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaatccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataactttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgattttgagaaccaagttgattttgatggattttgcagagaattagccacagaactcaccatcaaaatcatggacacattgagaaggatgaatcctgggttccagtatgtgattaactacttcctctatagttatttttgattcaattaaatttatttatttaataagttcaagaaaaaggaatc

SEQ ID NO: 839 - DNA, 516 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataactttttagcttcattgtcattgaaaagttctttttattaattatatttttattgcgtgtttggaatcccatttgagaaattaagaaaatcacgtttaaaaattgtgaaagtataactattaacttttgactaaacttgaaaaaatcacattttgatgtggaaccaaatctgatttgagaaccaagttga

SEQ ID NO: 840 - DNA, 819 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgatccctttttcactgcatccagcgcaggacgcccgccgaggcaggccaaggcgacgaggtggtcgttggtcaacgcggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatgggattttgcaggagaattagccacagaactcaccatcaaaatcatggacacaattgagaaggatgaatcctgggttccagtatgtgattaactacttcctctatagttatttttgattcaattaaatttatttatttaataagttcaagaaaaaagggaatctttatacttcagataaagctgttcttgaacatttttttttagtcattatttctagtttaaccga

SEQ ID NO: 841 - DNA, 627 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatattttattgcgtgtttggaatcccatttgagaaattaagaaatcacgtttaaaaattgtgaaagttataactattaacttttgactaaaacttgaaaaaactcacatttttgatgtggaaccaaatctgatttgagaaccagttgatttgatggattttgcaggagaattagccacagaactcaccatcaaaatcatggacacattgagaaggattgaatcctgggttccagtatgtgattaactacttcctctatagtta

SEQ ID NO: 842 - DNA, 730 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaatcagtccatggaagcttttcagacagcccttttctaaatagcctggtgggacacatcttgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaatttaaatttattttatttaataaagtttcaagaaaaatggaatctttatacttcagataaagctgttcttgaacattttttttcgtcattatc

SEQ ID NO: 843 - DNA, 790 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaatggggggtcaagccgtgggcctggcacagcaccggcaacagccgctggaccgtctccagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaactttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttataagttcaagaaaaaaggaatctttatacttcagataaagctgttcttgaacattttttttgtcattattctagtttaaccga

SEQ ID NO: 844 - DNA, 709 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaacagttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcatttgtcattgaaagttctttttattaattatatttttattgcgtgtttggaatcccatttgagaaataagaaatcacgtttaaaaatgtgaaagttataactattaacttttgactaaacttgaaaaaatcacatttttgatgtggaaccaaatctgattttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaaggaatctttatacttcagataaagctgttcttgaacatttttttt

SEQ ID NO: 845 - DNA, 664 bp, Artificial
  Glycine max FAD3A mutation created with TALEN pair GmFAD3_T01.1
cactgctttgttatgcctacctcatttcatttggctttagacaacttaaatttgagatctttattatgtttttttgcttatatggtaaagtgattcattcttcacattgaatagcctggtgggacacatcttgcattcctcaattcttgtgccataccatggatggttagttcatcccggcttttttgtttgtcattggaagttctttttattgattcaattttttatagcgtgttcggaaacgcgtttcagaaaataatgaaatacatcttgaatctgaaagttataacttttagcttcattgtcattgaaagttcttttattaattatatttttaattgcgtgtttggaatcccatttgagaaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgtt

SEQ ID NO: 846 - DNA, 733 bp, Artificial
  Glycine max FAD3A mutation created with TALEN pair GmFAD3_T01.1
cactgctttgttatgcctacctcatttcatttggctttagacaacttaaatttgagatctttattatgtttttttgcttatatggtaaagtgattcattcttcacatcatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaaattgtgaaagttataactattaacttttgactaaacttgaaaaaactcacatttttgatgtggaaccaaatctgattttgagaaccaagttgatttgatggattttgcagagaattagccacagaactcaccatcaaaatcatggacacattgagaaggatgaatcctgggttccagtatgtgattaactacttcctctatagttatttttgattcaattaaatttatttatttaataagttcaagaaaaaagggaatctttatacttcagataaagctgttcttgaacattttttttagtcattatcttagttaaccgag

SEQ ID NO: 847 - DNA, 731 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaatatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatattttattgcgtgtttggaatcccatttgagaaataagaaatcacgtttaaaaatgtgaaagttataactattaacttttgactaaacttgaaaaaatcacatttttgatgtggaaccaaatctgatttgagaaccaagttgaattttgatggattttgcaggagaattagccacagaactcaccattcaaaatcatggacacattgagaaggatgaatcctgggttccagtatgtgattaactacttcctctatagttattttgattcaattaaatttatttatttaataagttcaagaaaaaaggaatctttatacttcagataaagctgattcttgaacatttttttgtcattatcttagttaaccgag

SEQ ID NO: 848 - DNA, 694 bp, Artificial
  Glycine max FAD3A mutation created with TALEN pair GmFAD3_T01.1
  misc_feature (396): n is a or c or t or g
cactgctttgttatgcctacctcatttcatttggctttagacaacttaaatttgagatctttattatgttttttgcttatatggtaaagtgattcattcttcacattgaattgaggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttatttaattatatttttattgcggtttggaatcccattgngaaataagaaatcacgtttaaaaatgtgaaagttataactattaacttttgactaaacttgaaaaaatcacatttttgatgtggaaccaaatctgattttgagaaccaagttgatttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaaggaatcttatacttcagataaagc

SEQ ID NO: 849 - DNA, 662 bp, Artificial
  Glycine max FAD3A mutation created with TALEN pair GmFAD3_T01.1
cactgctttgttatgcctacctcatttcatttggctttagacaacttaaatttgagatcttttattatgtttttttgcttatatggtaaagtgattcattcttcacattgaattgaggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcttgtcattgaaaagtttctttttatttaattatatttttatttgcggtttggaatcccatttgagaaataagaaatcacgtttaaaattgtgaaagttataactattaacttttgactaaacttgaaaaaatcacatttttgatgtggaaccaaatctgattttgagaaccaagttgattttgatggattttgcaggagaattagccacagaactcaccatcaaaatcatggacacattgagaaggatgaattcctgggttccagtatgtgattaactacttcctctatagttatttttgattcaattaaatttatttattaat

SEQ ID NO: 850 - DNA, 609 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaccatggaagcttttcagacagccctttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccagttgatttgatggatttgcaggagaattagccacagaactcaccatcaaaatcatggacacattgagaaggatgaatcctgggttccagtatgtgattaactacttcc

SEQ ID NO: 851 - DNA, 451 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgtggcgatggcggcaagcaggcgctggagacggtccagcggctgttgccggtgctgtgccaggcccacggcttgaccccggagcaggtggtggccatcgccagccacgatggcggcaagcaggcgcttggagacggtccagcggctgttgccggtgctgtgccatggcccacggtggccatggaagcttttcagacagcccttttctaaatagcctggtgggacacatcttgcattcctcaattcttgtgccataccatggatggttagttcatcccggctttttgtttgtcatggaagttctttattgattcaattttatagcgtgttcggtaaacgc

SEQ ID NO: 852 - DNA, 607 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaataagaaatcacgtttaaaattgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaac

SEQ ID NO: 853 - DNA, 719 bp, Artificial
  Glycine max FAD3A mutation created with TALEN pair GmFAD3_T01.1
cactgctttgttagcctacctcatttcatttggctttagacaacttaaatttgagatctttattatgttttttgcttatatggtaaagtgattcattcttcacattgaattgaacatggaagcttttcagacagcccttttctaaatagcctggtgggacacatcttgcattcctcaattcttgtgccataccatggatggttagttcatcccggctttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaaatgtgaaagttataactattaacttttgactaaacttgaaaaaatcacatttttgatgtggaaccaaatctgattttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaaggaatctttatacttcagataaagctgttcttgaacattttttttgtc

SEQ ID NO: 854 - DNA, 728 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaaattgtgaaagttataactattaacttttgactaaacttgaaaaaactcacatttttgatgtggaaccaaatctgatttgagaaccaagttgatttgatggattttgcagagaattagccacagaactcaccatcaaaatcatggacacattgagaaggatgaatcctgggttccagtatgtgattaactacttcctctatagttatttttgattcaattaaatttattatttaataagttcaagaaaaaggaatctttatacttcagataaagctgttcttgaacatttttttagtcattatcttag

SEQ ID NO: 855 - DNA, 728 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaacagcaccggcaacagccgctggaccgtctccagcgcctgcttgccaccgccattgctggcgatggccaccacctgctggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagtaattagccacagaactcaccatcaaatcatggacacattgagaaggatgaatcctgggttccagtatgtgattaactacttcctctatagttatttttgattcaattaaatttattta

SEQ ID NO: 856 - DNA, 582 bp, Artificial
  Glycine max FAD3A mutation created with TALEN pair GmFAD3_T01.1
cactgctttgttatgcctacctcatttcatttggctttagacaacttaaatttgagatctttattatgtttttttgcttatatggtaaagtgattcattcttcacattgaattgagtgccatggaagcttttcagacagcccttttctaaatagcctggtgggacacatcttgcattcctcaattcttgtgccataccatggatggttagttcatcccggctttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaattgtgaaagttataactattaacttttgactaaacttgaaaaaatcacatttttgatgtggaaccaaatctgatttgagaaccaagttgattttgatggattttgcaggagaattagccacagactcaccatcaaaatcatggacacattgagaagga

SEQ ID NO: 857 - DNA, 715 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttattaataagttcaagaaaaaagggaatctttatacttcagataaagctgttcttgaacattttttt

SEQ ID NO: 858 - DNA, 639 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaagccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaatgtgaaagttataactattaacttttgactaaacttgaaaaaactcacatttttgatgtggaaccaaattctgattttgagaaccaagttgaatttgatggattttgcatggagaattagccacaagaactcaccattcaaaatcatggactacattgagaaggattgaatcctgggttccagtatgtgattaactacttcctctatagttattttt

SEQ ID NO: 859 - DNA, 622 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaatggccatggaagcttttcagacagcccttttctaaatagcctggtgggacacatcttgcattcctcaattcgtgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagtta

SEQ ID NO: 860 - DNA, 828 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaatcaccggcaacagccgctggaccgtctccagcgcctgcttgccgccatcgtggctggcgatggccaccacctgctccggggtcaatggccatggaagcttttcagacagcccttttctaaatagcctggtgggacacatcttgcattcctcaattcttgtgccataccatggatggttagttcatcccggcttttttgtttgtcattggaagttctttttattgattcaatttttatagcgtgttcggaaaacgcgtttcagaaaataatgaaatacatcttgaatctgaaagttataacttttagcttcattgtcattgaaagttcttttattaattatatttttattgcgtgtttggaatcccatttggagaaataagaaatcacgtttaaaatgtgaaagttataactattaacttttgactaaacttgaaaaattcacattttgatgtggaaccaaatctgatttgagaaccaaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaacggaatctttatactttcagataaaggctgtttcttgaacatttttttcgtcattatcttagtaaccgagaag

SEQ ID NO: 861 - DNA, 709 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataactttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagtatttttgattcaattaaatttattattaatagttcaagaaaaaggaatcttatacttcagataaagctgttcttgaacatttttttt

SEQ ID NO: 862 - DNA, 625 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataactttttagcttcattgtcattgaaaagttctttttattaattatatttttattgcgtgtttggaatcccatttgagaaataagaaatcacgtttaaaaattgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatag

SEQ ID NO: 863 - DNA, 732 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatattttattgcgtgtttggaatcccatttgagaaataagaaatcacgtttaaaatgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttattattaatagttcaagaaaagggaatcttatacttcagataaagctgttcttgaacatttttttagtcattatcttagttaaccgag

SEQ ID NO: 864 - DNA, 701 bp, Artificial
  Glycine max FAD3A mutation created with TALEN pair GmFAD3_T01.1
  misc_feature (686): n is a or c or t or g
cactgctttgttatgcctacctcatttcatttggctttagacaacttaaatttgagatctttattatgttttttgcttatatggtaaagtgattcattcttcacattgaattgaggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaattgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggtccagtatgtgattaactacttcctcctatagttattttggtattcaattaaatttatttatttaataagttcaagaaaaaaagggaatctttntacttcagataaagc

SEQ ID NO: 865 - DNA, 652 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataactttttagcttcattgtcattgaaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttattta

SEQ ID NO: 866 - DNA, 731 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttattattaataagttcaagaaaaaggaatcttatacttcagataaagctgttcttgaacatttttttagtcattatcttagttaaccgag

SEQ ID NO: 867 - DNA, 710 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttattattaataagttcaagaaaaaggaatctttatacttcagataaagctgttcttgaacatttttttt

SEQ ID NO: 868 - DNA, 606 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatattttattgcgtgtttggaatcccatttgagaaataagaaatcacgtttaaaatgtgaaagttataactattaacttttgactaaacttgaaaaaatcacattttgatgtggaaccaaattctgatttgagaaccaagttgaattttgatggattttgcatggagaattagccacagaactcaccattcaaaatcatggacacattgagaaggatgaatcctgggattccagtatgtgattaac

SEQ ID NO: 869 - DNA, 704 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgagccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaaattgtgaaagttataactattaacttttgactaaacttgaaaaaatcacatttttgatgtggaaccaaatctgatttgagaaccaagttgatttgatggattttgcaggagaattagccacagaactcaccatcaaaatcatggacacattgagaaggatgaatcctgggttccagtatgtgattaactacttcctctatagttattttgattcaattaaatttattattaataagttcaagaaaaaggaatcttatacttcagataaagctgttcttgaaca

SEQ ID NO: 870 - DNA, 651 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaatttggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataactttttagcttcattgtcattgaaagttctttttattaattatatttttattgcgtgtttggaatcccatttgagaaataagaaatcacgtttaaaaatgtgaaagttataactattaacttttgactaaacttgaaaaaatcacatttttgatgtggaaccaaatctgatttgagaaccaagttgattttgatggattttgcaggaaaattagccacagaactcaccatcaaaatcatggacacattgagaaggatgaatcctgggttccagtatgtgattaactacttcctctatagttatttttgattcaattaaatttattta

SEQ ID NO: 871 - DNA, 705 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattttcagacagccctttttctaaatagcctggtgggacacatcttgcattcctcaattcttgtgccataccatggatggttagttcatcccggctttttttgtttgtcattggaagttcttttattgattcaattttttatagcgtgttcggaaacgcgtttcagaaataatgaaatacatcttgaatctgaaagttataacttttagcttcattgtcattgaaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgatttttgatggattttgcaggagaattagccacagaactcaccatcaaaaatcatggacacattgagaaggatgaatcctgggttccagtatgtgattaactacttcctctatagttattttgattcaattaaaatttatttatttaataagttcaagaaaaaggaatctttatacttcagataaagctgttcttgaacattttttttgtcatta

SEQ ID NO: 872 - DNA, 739 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaattgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttattaataagttcaagaaaaagggaatctttatacttcagataaagctgttcttgaacattttttttagtcattatcttagttaaccgag

SEQ ID NO: 873 - DNA, 506 bp, Artificial
  Glycine max FAD3A mutation created with TALEN pair GmFAD3_T01.1
  misc_feature (465): n is a or c or t or g
cactgctttgttatgcctacctcatttcatttggctttagacaacttaaatttgagatctttattatgttttttgcttatatggtaaagtgattcattcttcacattgaaggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatattttattgcgtgtttggaatcccatttgagaataagaaatcacgtttaaaatgtgaaatgttataatctattaacttttgactaaatcttgaaaaaatcacnttttgaatgtggaaccaaattctgattttgagaaccaagtt

SEQ ID NO: 874 - DNA, 660 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaatcaacatttccgtgtcgcccttattcccttttttgcggcattttgccttcctgtttttgctcacccagaaacgctggtgaaagtaaaagatgctgaagatcagttgggtgcagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaataatgaatacatcttgaatctgaaagttataacttttagcttcattgtcattgaaagttcttttattaattatattttttattgcgtgtttggaatcccatttgagaaataagaaatcacgtttaaaatgtgaaagttataactattaacttttgactaacttgaaaaaaatcacatttttgatgtggaaccaaattctgatttgagaaccaagttgattttgatggattttgcaggagaattagccacagaac

SEQ ID NO: 875 - DNA, 759 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgacgtaaggtcatcgattacccatacgatgttccagattacgctatcgattggccatggaagcttttcagacagccctttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttataagttcaagaaaaaagggaatctttatacttcagataaagcatgttctttgaac

SEQ ID NO: 876 - DNA, 693 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacatctttattatgtttttttgccggtgctgtgccaggcccacggcttgaccccggagcaggtggtggccatcgccagccacgatggcggcaacagccgctggaggactataaagataccaggcgtttccccctggaagctccctcgtgcgctctcctgttccgaccctgccgcttaccggatggccatggaagcttttcagacagcccttttctaaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaattatgaaatacatcttgaatctgaaagttatacttttagcttcattgtcattgaaagttcttttattaattatatttttcattgcgtgtttggaatcccatttgagaataagaatcacgtttaaaatgtgaaagttataactattaactttgactaaacttgaaaaatcacatttttgatgtggaaccaaatctgatttgagaaccaagttgatttttatggatttttg

SEQ ID NO: 877 - DNA, 690 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacatggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgattttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaagggaatctttatacttcagataaagctg

SEQ ID NO: 878 - DNA, 640 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaagttataacttttagcttcattgtcattgaaagttcttttattaattatattttattgcgtgtttggaatcccatttgagaataagaaatcacgtttaaaattgtgaaagttataactattaacttttgactaaacttgaaaaaatcacatttttgatgtggaaccaaatctgatttgagaaccaagttgatttgatggattttgcaggagaattagccacagaactcaccatcaaaatcatggacacattgagaggatgaatcctgggttccagtatgtgattaactacttcctctatagttatttttgatcaattaaattta

SEQ ID NO: 879 - DNA, 639 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaaattatatttttattgcgtgtttgggaatcccatttgagaaataagaaatcacgtttaaaaattgtgaaagttataactattaacttttgactaaacttgaaaaaactcacatttttgatgtggaaccaaatctgatttgagaaccaagttgatttgatggattttgcaggagaattagccacagaactcaccatcaaaagtcatggacacattgagaaggatgaatcctgggttccagtatgtgattaactacttcctctatagttatttttggatt

SEQ ID NO: 880 - DNA, 738 bp, Artificial
  Glycine max FAD3A mutation created with TALEN pair GmFAD3_T01.1
  misc_feature (654); (684); (694): n is a or c or t or g
cactgctttgttatgcctacctcatttcatttggctttagacaacttaaatttgagatctttattatgttttttgcttatatggtaaagtgattcattcttcacattgaatcagtccatggaagcttttcagacagcccttttctaaatagcctggtgggacacatcttgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaaacttgaaaaaaactcacatttttgatgtggaaccaaattctgatttgagaaccaagttgatttttgatggattttgcaggagaattagccacagaactcaccatcaaaatcatggacacattgagaaggatgaatcctgggttccagtatgtgattaacctacttcctctatagtatttttgattcaattaatttatttntttataagttcaagaaaaatggaatctttntacttcaganaaagctgttctgaacattttttttcgtcattatcttagtaaccg

SEQ ID NO: 881 - DNA, 710 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaataatgaaatacatcttgaatctgaaagttataacttttagcttcattgtcattgaaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaaatcatggacacattgagaaggatgaatcctgggttccagtatgtgattaactacttcctctatagttatttttgattcaattaaatttatttatttaataagttcaagaaaaaaggaatctttatacttcagataaagctgttcttgaacattttttttgtcattatcttagttaaccgagaa

SEQ ID NO: 882 - DNA, 749 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaatggccatggaagcttttcagacagcccttttctaaatagcctggtgggacacatcttgcattcctcaattcttgtgccataccatggatggtttagttcatccccggctttttttgtttgtcattggaagttcttttattgattcaatttttatagcgtgttcggaaacgcgtttcagaaaataatgaaatacatcttgaatctgaaagttataacttttagcttcatttgtcattgaaagttctttttattaattatatttttattgcgttgtttggaatcccatttgagaaataagaaatcacgtttaaaaattgtgaaagttataactattaacttttgactaaacttgaaaaaatcacatttttgatgtggaaccaaatctgatttgagaaccaagtttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaagggaatctttatacttcagataaagctgattcttgaacattttttttgtcattatcttagttaaccgag

SEQ ID NO: 883 - DNA, 554 bp, Artificial
  Glycine max FAD3A mutation created with TALEN pair GmFAD3_T01.1
cactgctttgttatgcctacctcatttcatttggctttagacaacttaaatttgagatctttattatgtttttttgcttatatggtaaagtgattcattcttcacattgaattggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgattttgagaaccaagttgattttgatggattttgcaggagaattagccacagaactcaccattc

SEQ ID NO: 884 - DNA, 620 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaatccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagtta

SEQ ID NO: 885 - DNA, 732 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaatggccatggaagcttttcagacagccctttttctaaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacatgagaaggatgaatcctgggttccagtatgtgattaactacttcctctatagttattttgattcaattaaatttatttatttaataagttcaagaaaaaaggaatctttatacttcagataaagctgttcttgaacattttttttgtcattatcttag

SEQ ID NO: 886 - DNA, 731 bp, Artificial
  Glycine max FAD3A mutation created with TALEN pair GmFAD3_T01.1
  misc_feature (674): n is a or c or t or g
cactgctttgttatgcctacctcatttcatttggctttagacaacttaaatttgagatctttattatgttttttgcttatatggtaaagtgattcattcttcacattgaattggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataactttttagcttcattgtcattgaaagttctttttattaattatattttattgcgtgtttggaatcccatttgagaataagaaatcacgtttaaaattgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttattaatagttcaagaaaaggatcttntacttcagataaagctgttcttgaacatttttttagtcattatcttagttaaccgag

SEQ ID NO: 887 - DNA, 710 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaacagacagtggccatggaagcttttcagacagcccttttctaaatagcctggtgggacacatcttgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttc

SEQ ID NO: 888 - DNA, 482 bp, Artificial
  Glycine max FAD3A mutation created with TALEN pair GmFAD3_T01.1
  misc_feature (269): n is a or c or t or g
cactgctttgttatgcctacctcatttcatttggctttagacaacttaaatttgagatctttattatgttttttgcttatatggtaaagtgattcattcttcacattgaattgaacaatgccgggagcagacaagcccgtcagggcgcgtcagcgggtgttggcgggtgtcggggctggcttaactatgcggcatcagagcagtggccatggaagcttttcagacagcccttttctaaataggcctggtgggacacatcttgcattccncaattcttgtgccataccatggatggttagttcatcccggctttttgtttgtcattggaagttcttttatttgtattcaatttttatagtcgtgttcggaaacgcgtttcagaaataatgaaatacatcttgaatctgaaagttataacttttagcttcattgtcattgaaagtttcttttattaattatatttttattgcgtgttttggaat

SEQ ID NO: 889 - DNA, 746 bp, Artificial
  Glycine max FAD3A mutation created with TALEN pair GmFAD3_T01.1
cactgctttgttatgcctacctcatttcatttggctttagacaacttaaatttgagatctttattatgtttttttgcttatatggtaaagtgattcattcttcacattgaattgaagccatggaagcttttcagacagcccttttctaaatagcctggtgggacacatcttgcattcctcaattcttgtgccataccatggatggttagttcatcccggctttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaaattgtgaaagttataactattaacttttgactaaacttgaaaaaactcacattttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttattaataagttcaagaaaaaagggaatctttatacttcagataaagctgttcttgaacattttttttagtcattatcttagtttaaccgag

SEQ ID NO: 890 - DNA, 707 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaacatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaaattgtgaaagttataactattaacttttgactaaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaaatttatttatttaataagttcaagaaaaaaagggaatctttatacttcagataaagctgttc

SEQ ID NO: 891 - DNA, 708 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaaaggaatctttatacttcagataaagctgttcttgaacatttttttt

SEQ ID NO: 892 - DNA, 718 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaggccatggaagcttttcagacagcccttttctaaatagcctggtgggacacatcttgcattcctcaattcttgtgccataccatggatggttagttcatcccggctttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaaatcatggacacattgagaaggatgaatcctgggttccagtatgtgattaactacttcctctatagttattttgattcaattaaatttatttatttaataagttcaagaaaaaaaggaatctttatacttcagataaagctgttcttgaacatttttttt

SEQ ID NO: 893 - DNA, 554 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatattttattgcgtgtttggaatcccatttgagaaataagaaatcacgtttaaaattgtgaaagttataactattaacttttgactaaactgaaaaaactcacatttttgatgtggaaccaaatctgatttgagaaccaagttgatttgatggattttgcaggagaattagccacagaactcaccatc

SEQ ID NO: 894 - DNA, 781 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaacagtgggcctggcacagcaccggcaacagcgcctgcaccgtctccagcgcctgcttgccaccgccattgctggcgatggccaccacctgctggggggtcaagccgtgggcctggcacagcaccggcaatcagccgctggaggccatggaagcttttcagacagccctttttctaaatagcctggtgggacacatcttgcattcctcaattcttgtgccataccatggatggttagttcatcccggctttttgtttgtcattggaagttcttttattgattcaatttttatagcgtgttcggaaacgcgttcagaaaataatgaaatacatcttgaatctgaaagttataacttttagcttcatttgtcattgaaaagttcttttattaattatattttattgcgtgtttggaatccccatttgagaaataagaaatcacgtttaaaatgtgaaagttatactattaactttgactaaactgaaaaaatcacatttttgatgtggaaccaaatctgatttgagaaccaagttgattttgatggattttgcaggagaattagccacagaactcaccattcaaaatcatggacacattgagaaggatgaatcctgggttccatgtatgtgattaactacttcctctatagttatttttgattcaattaa

SEQ ID NO: 895 - DNA, 641 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaaatgtgaaagttataactattaacttttgactaaaacttgaaaaaatcacatttttgatgtggaaccaaattctgattttgagaaccaagttgaattttgatggattttgcatggagaattagccacagaactcaccattcaaaatcatggacacattgagaaggattgaatcctgggattccagtatgtgattaactacttcctctatagttatttttga

SEQ ID NO: 896 - DNA, 696 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattcagacagcccttttctaaatagcctggtgggacacatcttgcattcctcaattcttgtgccataccatggatggttagttcatcccggctttttttgtttgtcattggaagttcttttattgattcaatttttatagcgtgttcggaaacgcgtttcagaaataatgaaatacatcttgaatctgaaagttataacttttagcttcattgtcattgaaagttcttttattaattatatttttattgcgtgtttggaatcccatttgagaaatagaaatcacgtttaaatgtgaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaaggaatctttatacttcagataaagctgttcttgaacatttttttgtca

SEQ ID NO: 897 - DNA, 605 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaaattgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgt

SEQ ID NO: 898 - DNA, 720 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaacagacagtggccatggaagcttttcagacagcccttttctaaatagcctggtgggacacatcttgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaaacttgaaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaac

SEQ ID NO: 899 - DNA, 701 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattggccatggaagcttttcagacagcccttttctaaatagcctggtgggacacatcttgcattcctcaattcttgtgccataccatggatggttagttcatcccggctttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaaattgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggattgaatcctgggttccagtatgtgattaactacttcctctatagttattttgattcaattaaatttatttatttaataagttcaagaaaaaaggaatctttatacttcagataaagctgtt

SEQ ID NO: 900 - DNA, 614 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaacacctgctggggggtcaagccgtgggcctggcacagcaccggcaacagccgctggaccgtctccagcgcctgcttgccaccgccattgctggcgatggccaccacctgctggggggtcaagccgtgggcctggcacagcaccggggccatggaagcttttcagacagcccttttctaaatagcctggtgggacacatcttgcattcctcaattcttgtgccataccatggatggttagttcatcccggctttttgtttgtcattggaagttcttttattgattcaatttttatagcgtgttcggaaacgcgtttcagaaaataatgaaatacatcttgaatctgaaagttataacttttagcttcaattgtcattgaaaagttcttttattaattatattttattgcgtgtttggaatcccatttgagaaataagtaaatcacgtttaaaatgtgaaagttataactattaacttttgactaaacttgaaaaaatcaca

SEQ ID NO: 901 - DNA, 712 bp, Artificial
  Glycine max FAD3A mutation created with TALEN pair GmFAD3_T01.1
actgctttgttatgcctacctcatttcatttggctttagacaacttaaatttgagatctttattatgttttttgcttatatggtaaagtgattcattcttcacattgaattgatggagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttcttttattaattatatttttattgcggtttggaatcccatttgagaaataagaaatcacgtttaaaaattgtgaaagttataactattaacttttgactaaacttgaaaaaactcacatttttgatgtggaaccaaatctgattttgagaaccaagttgattttgatggattttgcaggagaattagccacagactcaccatcaaaatcatggacacattgagaaggatgaatcctgggttccagtatgtgattaactacttcctctatagttatttttggattcaattaaaatttatttattaataagttcaagaaaaagggaatctttatacttcagataaagctgttcttgaacatttttttt

SEQ ID NO: 902 - DNA, 723 bp, Artificial
  Glycine max FAD3A mutation created with TALEN pair GmFAD3_T01.1
  misc_feature (147): n is a or c or t or g
cactgctttgttatgcctacctcatttcatttggctttagacaacttaaatttgagatctttattatgttttttgcttatatggtaaagtgattcattcttcacattgaattgaaggccatggaagcttttcagacagcccttttcnaaatagcctggtgggacacatcttgcattcctcaattcttgtgccataccatggatggttagttcatcccggcttttttgtttgtcattggaagttcttttattgattcaattttatagcgtgttcggaaacgcgtttcagaaaataatgaaatacatcttgaatctgaaagttataacttttagcttcattgtcattgaaagttctttttatttaattatatttttattgcgtgttttggaatcccatttgagaaataagaaatcacgtttaaaaattgtgaaagttataactattaactttttgactaaactttgaaaaaatcacatttttgatgtggaaccaaatctgatttgagaaccaagttgattttgatggattttgcaggagaattagccacagaactcaccatcaaaaatcatggacacatgagaaggatgaatcctgggttccagtatgtgattaactacttcctctatagttattttgattcaattaaatttatttatttaataagttcaagaaaaaaagggaatctttatacttcagataaagctgttcttgaacatttttttt

SEQ ID NO: 903 - DNA, 666 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataaacttttagcttcattgtcattgaaaagttctttttattaattatatttttattgcgtgtttggaatcccatttgagaaataagaaatcacgtttaaaatgtgaaagttataactattaacttttgactaaacttgaaaaaactcacatttttgatgtggaaccaaatctgattttgagaaccaagttgaattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaa

SEQ ID NO: 904 - DNA, 627 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgagccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaataagaaatcacgtttaaaattgtgaaagttataactattaacttttgactaaacttgaaaaaactcacatttttgatgtggaaccaaatctgatttgagaaccaagttgattttgatggattttgcatggagaattagccacagaactcaccatcaaaatcatggacacattgagaaggatgaatcctgggttccagtatgtgattaactacttcctctatagtta

SEQ ID NO: 905 - DNA, 711 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaagaagctttttcagacagccctttttctaaatagcctggtgggacacatcttgcattcctcaattcttgtgccataccatggatggttagttcatcccggcttttttgtttgtcattggaagttcttttattgattcaatttttatagcgtgttcggaaacgcgttcagaaaataatgaaatacatcttgaatctgaaagttataactttttagcttcattgtcattgaaagttctttttattaattatatttttattgcgtgtttggaatcccatttgagaaataagaaatcacgtttaaaaattgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttattaatagttcaagaaaaagggaatctttatacttcagataaagctgttcttgaacatttttttt

SEQ ID NO: 906 - DNA, 732 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataactttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggattgaatcctgggttccagtatgtgattaactacttcctctatagttattttgattcaattaaatttatttattaataagttcaagaaaaaggaatcttatacttcagataaagctgttcttgaacattttttttgtcaattatcttagttaaccg

SEQ ID NO: 907 - DNA, 742 bp, Artificial
  Glycine max FAD3A mutation created with TALEN pair GmFAD3_T01.1
  misc_feature (400): n is a or c or t or g
cactgctttgttatgcctacctcatttcatttggctttagacaacttaaatttgagatctttattatgttttttgcttatatggtaaagtgattcattcttcacattgaattgaaccatggaagctttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttatttaattatatttttattgcggttttggaatcccatttgngaaataagaaatcacgtttaaaaattgtgaaagttataactattaacttttgactaaacttgaaaaaatcacatttttgatgtggaaccaaatctgattttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttattaataagttcaagaaaaaaggaatctttatacttcagataaagctgttcttgaacattttttttgtcattatcttagttaaccgag

SEQ ID NO: 908 - DNA, 731 bp, Artificial
  Glycine max FAD3A mutation created with TALEN pair GmFAD3_T01.1
cactgctttgttatgcctacctcatttcatttggctttagacaacttaaatttgagatctttattatgtttttttgcttatatggtaaagtgattcattcttcacattgaattgacatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatattttattgcgtgtttggaatcccatttgagaaataagaaatcacgtttaaaattgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttattatagttcagaaaaaggaatcttatacttcagataaagctgttcttgaacattttttttagtcattatcttagttaaccgag

SEQ ID NO: 909 - DNA, 703 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaggccatggaagcttttcagacagcccttttctaaatagcctggtgggacacatcttgcattcctcaattcttgtgccataccatggatggttagttcatcccggctttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaaatgtgaaagttataactattaacttttgactaaacttgaaaaaatcacatttttgatgtggaaccaaatctgatttgagaaccaagttgattttgatggattttgcaggagaattagccacagaactcaccatcaaaaatcatggacacattgagaaggatgaatcctgggttccagtatgtgattaactacttcctctatagttattttgattcaattaaatttatttattaataagttcaagaaaaaaggaatctttatacttcagataaagctgtt

SEQ ID NO: 910 - DNA, 704 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgatggccatggaagcttttcagacagcccttttctaaatagcctggtgggacacatcttgcattcctcaattcttgtgccataccatggatggttagttcatcccggctttttttgtttgtcattggaagttcttttattgattcaatttttatagcgtgttcggaaacgcgtttcagaaaataatgaaatacatcttgaatctgaaagttataacttttagcttcatttgtcattgaaagttctttttatttaattatatttttattgcgtgtttggaatcccatttgagaaataagaaatcacgtttaaaaatgtgaaagttataactattaacttttgactaaacttgaaaaaatcacatttttgatgtggaaccaaatctgattttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaagggaatctttatacttcagataaagctg

SEQ ID NO: 911 - DNA, 685 bp, Artificial
  Glycine max FAD3A mutation created with TALEN pair GmFAD3_T01.1
actgtttgttatgcctacctcatttcatttggctttagacaacttaaatttgagatctttattatgttttttgcttatatggtaaagtgattcattcttcacattgaattgacatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaaatgtgaaagttataactattaacttttgactaaacttgaaaaaatcacatttttgatgtggaaccaaatctgatttgagaaccaagttgaattttgatggattttgcatggagaattagccacagaactcaccattcaaaaatatggacacattgagaaggatgaatcctgggttccagtatgtgattaactacttcctctatagttattttgattcaattaaatttatttattaataagttcaagaaaaaaggaatcttatacttca

SEQ ID NO: 912 - DNA, 716 bp, Artificial
  Glycine max FAD3A mutation created with TALEN pair GmFAD3_T01.1
  misc_feature (682): n is a or c or t or g
cactgctttgttatgcctacctcatttcatttggctttagacaacttaaatttgagatctttattatgttttttgcttatatggtaaagtgattcattcttcacattgaatggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatattttattgcgtgtttggaatcccatttgagaataagaaatcacgtttaaaatgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggattgaatcctgggttccagtatgtgattaacatacttcctctatagttattttggattcaattaaatttatttatttaataagttcaagaaaaaaagggaatctttntacttcagataaagctgttcttgaacattttttt

SEQ ID NO: 913 - DNA, 708 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattggccatggaagcttttcagacagcccttttctaaatagcctggtgggacacatcttgcattcctcaattcttgtgccataccatggatggttagttcatcccggcttttttgtttgtcattggaagttcttttattgattcaattttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttattattaataagttcaagaaaaaggaatcttatacttcagataaagctgttcttgaacattttttt

SEQ ID NO: 914 - DNA, 614 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaaattgtgaaagttataactattaacttttgactaaactgaaaaaactcacatttttgatgtggaaccaaatctgattttgagaaccaagttgatttgatggattttgcaggagaattagccacagaactcaccatcaaaatcatggacacattgagaaggatgaatcctgggttccagtatgtgattaactacttcctctatag

SEQ ID NO: 915 - DNA, 625 bp, Artificial
  Glycine max FAD3A mutation created with TALEN pair GmFAD3_T01.1
  misc_feature (440): n is a or c or t or g
cactgctttgttatgcctacctcatttcatttggctttagacaacttaaatttgagatctttattatgttttttgcttatatggtaaagtgattcattcttcacatttggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttataattatatttttattgcgtgtttggaatcccatttgagaaataagaaatcacgtttaaaatgtgaaagttataactattaactttgnctaaaacttgaaaaaatcacatttttgatgtggaaccaaatctgattttgagaaccaagttgaattttgatggattttgcaggagaattagccacagaactcaccatcaaaatcatggacacattgagaaggattgaatcctgggttccagtatgtgattaactacttcctctatagttattttg

SEQ ID NO: 916 - DNA, 622 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacatttggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcatttgtcattgaaagttctttttattaattatattttattgcgtgtttggaatcccatttgagaaataagaaatcacgtttaaaattgtgaaagttataactattaacttttgactaaacttgaaaaaactcacatttttgatgtggaaccaaatctgattttgagaaccaagttgattttgatggattttgcaggagaattagccacagaactcaccatcaaaatcatggacacattgagaaggatgaatcctgggttccagtatgtgattaactacttcctctatagtta

SEQ ID NO: 917 - DNA, 729 bp, Artificial
  Glycine max FAD3A mutation created with TALEN pair GmFAD3_T01.1
actgtttgttatgcctacctcatttcatttggctttagacaacttaaatttgagatctttattatgttttttgcttatatggtaaagtgattcattcttcacattgaattgacatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataaacttttagcttcattgtcattgaaagttctttttattaattatatttttattgcgtgtttggaatcccatttgagaaataagaaatcacgtttaaaaattgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaagggaatctttatacttcagataaagctgttcttgaacattttttttagtcattatcttag

SEQ ID NO: 918 - DNA, 508 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaataatgaaatacatcttgaatctgaaagttataacttttagcttcatttgtcattgaaaagtttcttttattaattatatttttattgcgtgtttggaatcccatttgagaattaagaaatcacgttttaaaatgtgaaagttataatctataacttttgactaaatcttgaaaaaactcaacatttttgaatgtggaaccaaattctgattttgag

SEQ ID NO: 919 - DNA, 731 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgtggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaagggaatctttatacttcagataaagctgttcttgaacattttttttgtcattatcttagttaacgag

SEQ ID NO: 920 - DNA, 705 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgagtggccatggaagcttttcagacagcccttttctaaatagcctggtgggacacatcttgcattcctcaattcttgtgccataccatggatggttagttcatcccggctttttttgtttgtcattggaagttcttttattgattcaatttttatagcgtgttcggaaacgcgttcagaaaataatgaaatacatcttgaatctgaaaagttataaactttttagcttcattgtcattgaaagttcttttattaattatatttttattgcgtgtttggaatcccatttgagaaataagaaatcacgtttaaaaatgtgaaagttataactattaacttttgactaaacttgaaaaaatcacatttttgatgtggaaccaaatctgatttgagaaccaagttgattttgatggattttgcaggagaattagccacagaactcaccatcaaaaatcatggacacattgagaaggatgaatcctgggttccagtatgtgattaactacttcctctatagttattttgattcaattaaaatttatttatttaataagttcaagaaaaaaaggaatctttatacttcagataaagctg

SEQ ID NO: 921 - DNA, 738 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaacaaacaggagagcgcacgagggagcttccagggggaaacgcctggtatctttatagtcctggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgattgagaaccaagttgattttgatggattttgcaggagtaattagccacagaactcaccatcaaaatcatggacacattgagaaggatgaatcctgggttccagtatgtgattaactacttcctctatagttatttttgattcaattaaatttatttatttaataagttcaagaaaaaagggtaat

SEQ ID NO: 922 - DNA, 607 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattggccatggaagcttttcagacagcccttttctaaatagcctggtgggacacatcttgcattcctcaattcttgtgccataccatggatggttagttcatcccggctttttttgtttgtcattggaagttcttttattgattcaatttttatagcgtgttcggaaacgcgtttcagaaaataatgaaatacatcttgaatctgaaaagttataactttttagcttcattgtcattgaaaagttctttttattaattatatttttattgcgtgtttggaatcccatttgagaaataagaaaatcacgtttaaaaatgtgaaagttataactattaacttttgactaaacttgaaaaaatcacatttttgatgtggaaccaaatctgattttgagaaccaagttgattttgatggatttgcagagaattagccacagaactcaccatcaaaaatcatggacacattgagaaggatgaatcctgggttccagtatgtga

SEQ ID NO: 923 - DNA, 623 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaatggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagtta

SEQ ID NO: 924 - DNA, 735 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgacatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaattgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttattaataagttcaagaaaaagggaatctttatacttcagataaagctgttcttgaacatttttttagtcattatcttagttaaccgag

SEQ ID NO: 925 - DNA, 737 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggattgaatcctgggttccagtatgtgattaactacttcctctatagttattttgattcaattaaatttatttatttaataagttcaagaaaaaaaggaatctttatacttcagataaagctgttcttgaacattttttttgtcattatcttagttaaccgag

SEQ ID NO: 926 - DNA, 740 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgagccatggaagcttttcagacagcccttttctaaatagcctggtgggacacatcttgcattcctcaattcttgtgccataccatggatggttagttcatcccggctttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaaaggaatctttatacttcagataaagctgttcttgaacatttttttgtcattatcttagttaaccgag

SEQ ID NO: 927 - DNA, 737 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgtggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaaattgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaagggaatctttatacttcagataaagctgttcttgaacattttttttagtcattatcttagttaacgag

SEQ ID NO: 928 - DNA, 702 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaacatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatattttattgcgtgtttggaatcccatttgagaaataagaaatcacgtttaaaaatgtgaaagttataactattaacttttgactaaacttgaaaaaatcacatttttgatgtggaaccaaattctgatttgagaaccaagtttgattttgatggattttgcaggagaattagccacagactcaccattcaaaatcatggacacattgagaaggattgaatcctgggttccagtatgtgattaactacttcctctatagttatttttgtattcaattaaaatttattttatttaataagttcaagaaaaaaagggaatctttatacttcagataaagc

SEQ ID NO: 929 - DNA, 729 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaacagccgctggaccgtctccagcgcctgcttgccaccattattgctggcgatggccaccacctgctggggggtcaagccgtgggcctgccatggaagcttttcagacagcccttttctaaatagcctggtgggacacatcttgcattcctcaattcttgtgccataccatggatggttagttcatcccggcttttttgtttgtcattggaagttctttttattgattcaatttttatagcgtgttcggaaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaattcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaa

SEQ ID NO: 930 - DNA, 702 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtcaagccgtggccatggaagcttttcagacagcccttttctaaatagcctggtgggacacatcttgcattcctcaattcttgtgccataccatggatggttagttcatcccggcttttttgtttgtcattggaagttcttttattgattcaattttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaatgtgaagttataactattaacttttgactaaacttgaaaaaatcacattttgatgtggaaccaaatctgatttgagaaccaagttgattttgatggatttttgcaggagaattagccacagaactcaccatcaaaaatcatggacacattgagaaggatgaatcctgggttccagtatgtgattaactacttcctctatagttatttttgattcaattaaaatttattatttaataagttcaagaaaaaaggaatctttatacttcagataaagctgttacttgaacattttttttgtcatta

SEQ ID NO: 931 - DNA, 733 bp, Artificial
  Glycine max FAD3A mutation created with TALEN pair GmFAD3_T01.1
actgtttgttatgcctacctcatttcatttggctttagacaacttaaatttgagatctttattatgttttttgcttatatggtaaagtgattcattcttcacattgaattgacatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgattttgagaaccaagttgaattttgatggattttgcatggagaattagccacagaactcaccatcaaaatcatggacacattgagaaggatgaatcctgggttccagtatgtgattaactacttcctctatagttattttgattcaattaaatttatttattaataagttcaagaaaaaggaatctttatacttcagataaagctgattcttgaacatttttttgtcattatcttagttaaccgag

SEQ ID NO: 932 - DNA, 771 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaacagcaccggcaacagccgctggaccgtctccagcgcctgcttgccaccgccattgctggcgatggccaccacctgctggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaattcacgtttaaaatgtgaaagttataactattaacttttgactaaacttgaaaaaatcacattttgatgtggaaccaaatctgatttgagaaccaagttgattttgatggattttgcaggagtaattagccacagaactcaccatcaaaatcatggacacaattgagaaggatgaatccttgggtttccagtatgtgattaactacttcctctatagttatttttgattcaattaaatttatttatttaataagttcaagaaaaaggaatctttatacttcagat

SEQ ID NO: 933 - DNA, 735 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatattttattgcgtgtttggaatcccatttgagaaataagaaatcacgtttaaaatgtgaaagttataactattaacttttgactaaacttgaaaaaatcacatttttgatgtggaaccaaatctgattttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttattaataagttcaagaaaaaggaatctttatacttcagataaagctgttcttgaacattttttttgtcattatcttagttaaccgag

SEQ ID NO: 934 - DNA, 728 bp, Artificial
  Glycine max FAD3A mutation created with TALEN pair GmFAD3_T01.1
  misc_feature (682): n is a or c or t or g
cactgctttgttatgcctacctcatttcatttggctttagacaacttaaatttgagatctttattatgttttttgcttatatggtaaagtgattcattcttcacattgaattgaaccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaattgtgaaagttataactattaacttttgactaaacttgaaaaaatcacatttttgatgtggaaccaaatctgattttgagaaccaagttgattttgatggattttgcaggagaattagccacagaactcaccatcaaaatcatggacacattgagaaggattgaatcctgggttccagtatgtgattaactacttcctctatagttattttgattcaattaaatttatttatttaataagttcaagaaaaaagggaatctttntactcagataaagctgtcttgaacattttttttgtcattatcttag

SEQ ID NO: 935 - DNA, 710 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacatggccatggaagcttttcagacagcccttttctaaatagcctggtgggacacatctgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaattgtgaaagttataactattaacttttgactaaacttgaaaaaatcacatttttgatgtggaaccaaatctgattttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaagggaatctttatacttcagataaagctgttcttgaacatttttttt

SEQ ID NO: 936 - DNA, 656 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacatcatggaagcttttcagacagcccttttctaaatagcctggtgggacacatctgcattcctcaattcttgtgccataccatggatggttagttcatcccggcttttttgttgtcattggaagttcttttattgattcaatttttatagcgtgttcggaaacgcgtttcagaaaataatgaaatacatcttgaatctgaaagttataacttttagcttcattgtcattgaaagttcttttattaattatattttattgcgtgtttggaatcccatttgagaaataagaaatcacgtttaaaattgtgaaagttataactattaacttttgactaaacttgaaaaaatcacatttttgatgtggaaccaaatctgattttgagaaccaagttgaattttgatggattttgcaggagaattagccacagaactcaccatcaaaatcatggacacattgagaaggatgaatcctgggttccagtatgtgattaactacttcctctatagtattttgattcaattaaatttatttattaataagttcaagaaaaaa

SEQ ID NO: 937 - DNA, 632 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaaatagccatggaagcttttcagacagcccttttctaaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaatgtgaaagttataactattaacttttgactaaacttgaaaaaatcacattttgatgtggaaccaaatctgattttgagaaccaagttgattttgatggattttgcaggagaattagccacagaactcaccatcaaaatcatggacacattgagaggatgaatcctggttccagtatgtgattaactacttcctctatagttattttgattc

SEQ ID NO: 938 - DNA, 599 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgattttgagaaccaagttgattttgatggattttgcaggagaattagccacagaactcaccatcaaaatcatggacacattgagaaggatgaatcctgggttccagt

SEQ ID NO: 939 - DNA, 581 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttctttttatttaaattatatttttcatttgcgtgtttgggaaatcccatttgagaaataagaaatcacgtttaaaaattgtgaaagttataactattaacttttgactaaacttgaaaaaactcacatttttggatgtggaaccaaaagtctgattttgagaaccaagttgatttgatggattttgcaggagaattagccacagaactcaccatcaaaagtcatggac

SEQ ID NO: 940 - DNA, 617 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagtta

SEQ ID NO: 941 - DNA, 739 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaattgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaagggaatctttatacttcagataaagctgttcttgaacatttttttagtcattatcttagttaaccgag

SEQ ID NO: 942 - DNA, 643 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaattta

SEQ ID NO: 943 - DNA, 923 bp, Artificial
  Glycine max FAD3A mutation created with TALEN pair GmFAD3_T01.1
  misc_feature (651); (828): n is a or c or t or g
cactgctttgttatgcctacctcatttcatttggctttagacaacttaaatttgagatctttattatgtttttttgcttatatggtaaagtgattcattcttcacattgaattgaacaccgccattgctggcgatggccaccacctgctggggggtcaagccgtgggcctggcacagcaccggcaacagccgctggaccgtcggcaaacagtggtccggcgcacgcgctctggaggccttgctcacggtggcgggagagttgagaggtccaccgttacagttggacacaggccaacttctcaagattgcaaaaacgtggcggcgtgaccgcagtggccatggaagctttttcagacagcccttttctaaatagcctggtgggacacatcttgcattcctcaattcttgtgccataccatggatggttagttcatcccggcttttttgtttgtcatggaagttcttttattgattcaatttttatagcgtgttcggaaacgcgtttcagaaataatgaaatacatcttgaatctgaaagttataacttttagcttcattgtcattgaaaagttcttttattaattatatttttattgcgtgtttggaatcccatttgagaaataagaaatcacgtttaaaatgtgaaagttntaactattaacttttgactaaactttgaaaaactcacatttttgatgtggaaccaaattctgatttgagaaccaagttgatttttgatggtatttttgcaggatgaagttaacgaccacagaactcaccatcaaaatcattggacacattgagaaggatgaatcctgggttccagtntgtgattaaactacttcctctatagttatttttcgattcaattaaatttatttatttaataagttcaagaaaaagggaatctttatacttcagat

SEQ ID NO: 944 - DNA, 737 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgattaccagacagcccttttcagacagcccttttctaaatagcctggtgggacacatcttgcattcctcaattcttgtgccataccatggatggttagttcatcccggctttttttgtttgtcattggaagttcttttattgattcaatttttatagcgtgttcggaaacgcgtttcagaaaataatgaaatacatcttgaatctgaaagttataactttttagcttcattgtcattgaaagttctttttattaattatatttttattgcgtgtttggaatcccatttgagaaataagaaatcacgtttaaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaaggaatctttatacttcagataaagctgttcttgaacattttttttgtcattatcttagttaaccgag

SEQ ID NO: 945 - DNA, 757 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaatgagctgataccgctcgccgcagccgaacgaccgagcgcagcgagtcagtgagcgaggaagcggaagagcgcccaatacgcaaaccgcctctccccgcgcgttggccgattcattaatgcagcttggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaataatgaaatacatcttgaatctgaaagttataacttttagcttcattgtcattgaaagttcttttattaattatatttttattgcgtgttggaatcccatttgagaaataagaatcacgtttaaaatgtgaaagttataactattaactttgactaaacttgaaaaaagtcacatttttgatgtggaaccaaatctgatttgagaaccaagttgattttgatggattttgcaggagaattagccacagaactcaccatcaaaatcatggacacattgagaagggatgaatcctgggttccagtatgtgattaactacttcctctatagttattttttgattcaatt

SEQ ID NO: 946 - DNA, 727 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattcatggaagcttttcagacagcccttttctaaatagcctggtgggacacatctgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgattttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaaaggaatctttatacttcagataaagctgttcttgaacattttttttgtcattatcttagttaaccgag

SEQ ID NO: 947 - DNA, 739 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaatcagtccatggaagcttttcagacagcccttttctaaatagcctggtgggacacatcttgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagtatttttgattcaattaaatttatttatttaataagttcaagaaaaatggaatcttttatacttcagataaagctgttctgaacattttttttcgtcattatctaagttaacctga

SEQ ID NO: 948 - DNA, 598 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgatggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcatttgtcattgaaagttctttttattaattatatttttattgcgtgtttggaatcccatttgagaaataagaaatcacgttttaaaaatgtgaaagttataactattaacttttgactaaacttgaaaaaatcacatttttgatgtggaaccaaatctgattttgagaaccaagttgaattttgatggattttgcaggagaattagccacagaactcaccatcaaaatcatggactacattgagaaggattgaatcctggg

SEQ ID NO: 949 - DNA, 611 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaacaagattgcaaaacgtggcggcgtgaccgcagtggaggcagtgcatgcatggcgcaatgcactgacgggtgccccgctcaacttgacccccagcaggtgatggccatggaagcttttcagacagcccttttctaaatagcctggtgggacacatcttgcattcctcaattcttgtgccataccatggatggttagttcatcccggctttttgtttgtcattggaagttcttttattgattcaatttttatagcgtgttcggaaacgcgtttcagaaataatgaatacatcttgaatctgaaagttataacttttagcttcattgtcattgaaagttcttttattaattatattttttattgcgtgtttggaatcccatttgagaaataagaaatcacgtttaaaatgtgaaagttataactattaacttttgactaacttgaaaaaaactcacatttttgatgtggaaccaaattctgatttgagaaccaagttga

SEQ ID NO: 950 - DNA, 635 bp, Artificial
  Glycine max FAD3A mutation created with TALEN pair GmFAD3_T01.1
  misc_feature (340): n is a or c or t or g
cactgctttgttatgcctacctcatttcatttggctttagacaacttaaatttgagatctttattatgttttttgcttatatggtaaagtgattcattcttcacattgaattgaagccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataactttttagcttcatntcattgaaaagttctttttattaattatatttttattgcgtgtttggaatcccatttgagaaataagaaatcacgtttaaaaattgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgg

SEQ ID NO: 951 - DNA, 717 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataactttttagcttcattgtcattgaaagttctttttattaattatatttttattgcgtgtttggaatcccatttgagaaataagaaatcacgtttaaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaaagggaatctttatacttcagataaagctgttcttgaacatttttttt

SEQ ID NO: 952 - DNA, 734 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaaccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttcttttattaattatatttttattgcgtgtttggaatcccatttgagaaataagaaatcacgtttaaaaatgtgaaagttataactattaacttttgactaaacttgaaaaaatcacatttttgatgtggaaccaaatctgattttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaaaggaatctttatacttcagataaagctgttcttgaacattttttttgtcattatcttagtt

SEQ ID NO: 953 - DNA, 743 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaattgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaagggaatctttatacttcagataaagctgttcttgaacatttttttagtcattatcttagttaaccgag

SEQ ID NO: 954 - DNA, 696 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttattaataagttcaagaaaaaaggaatctttatacttcagataaagctg

SEQ ID NO: 955 - DNA, 716 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaaatcatggacacattgagaaggatgaatcctgggttccagtatgtgattaactacttcctctatagttatttttgattcaattaaaatttatttatttaataagttcaagaaaaaaggaatctttatacttcagataaagctgttcttgaacattttttttagtcattatcttagttaaccgag

SEQ ID NO: 956 - DNA, 625 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaccatggaagcttttcagacagcccttttctaaatagcctggtgggacacatcttgcattcctcaattcttgtgccataccatggatggttagttcatcccggctttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagtta

SEQ ID NO: 957 - DNA, 736 bp, Artificial
  Glycine max FAD3A mutation created with TALEN pair GmFAD3_T01.1
cactgctttgttatgcctacctcatttcatttggctttagacaacttaaatttgagatctttattatgtttttttgcttatatggtaaagtgattcattcttcacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaaattgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttattaataagttcaagaaaaaagggaatctttatacttcagataaagctgttcttgaacattttttttagtcattatcttagttaaccgag

SEQ ID NO: 958 - DNA, 702 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattcatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaataagaaatcacgtttaaaattgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttattaataagttcaagaaaaaggaatctttatacttcagataaagctgttcttgaacatttttttt

SEQ ID NO: 959 - DNA, 664 bp, Artificial
  Glycine max FAD3A mutation created with TALEN pair GmFAD3_T01.1
  misc_feature (273): n is a or c or t or g
cactgctttgttatgcctacctcatttcatttggctttagacaacttaaatttgagatctttattatgttttttgcttatatggtaaagtgattcattcttcacattgaattgatggtaaagtgattcattcgtggccatggaagcttttcagacagcccttttctaaatagcctggtgggacacatcttgcattcctcaattcttgtgccataccatggatggttagttcatcccggcttttttgtttgtcattggaagttctttttattgnttcaatttttatagcgtgttcggaaacgcgtttcagaaaataatgaaaatacatcttgaatctgaaagttataacttttagcttcattgtcattgaaagttcttttattaattatatttttatttgcgtgtttggaatcccatttgagaaataagaaatcacgtttaaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaa

SEQ ID NO: 960 - DNA, 660 bp, Artificial
  Glycine max FAD3A mutation created with TALEN pair GmFAD3_T01.1
cactgctttgttatgcctacctcatttcatttggctttagacaacttaaatttgagatctttattatgtttttttgcttatatggtaaagtgattcattcttcacattgaattgaatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatattttattgcgtgtttggaatcccatttgagaaataagaaatcacgtttaaaatgtgaaagttataactattaacttttgactaaacttgaaaaaactcacatttttgatgtggaaccaaatctgatttgagaaccaagttgatttgatggattttgcaggagaattagccacagaactcaccatcaaaatcatggacacattgagaaggatgaatcctgggttccagtatgtgattaactacttcctctatagtatttttgattcaattaaatttatttatttaataagttcaa

SEQ ID NO: 961 - DNA, 712 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacatggccatggaagctttttcagacagcccttttctaaatagcctggtggggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaagggaatctttatacttcagataaagctgttcttgaacatttttttt

SEQ ID NO: 962 - DNA, 588 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaacagcgcctgcaccgtctccggggtcaagccgtgggcctggcacagcaccggcaacagccgctggaccacagtggccatggaagcttttcagacagcccttttctaaatagcctggtgggacacatcttgcattcctcaattcttgtgccataccatggatggttagttcatcccggctttttgtttgtcattggaagttcttttattgattcaatttttatagcgtgttcggaaaacgcgtttcagaaaataatgaaatacatcttgaatctgaaagttataacttttagcttcattgtcattgaaagttactttattaaattatatttttattgcatgtgtttggaatcccatttgagaaataagaaattcacgtttaaaaatgatgaaagttattaactatttaactttgactaaacttgaaaaaaatcacatttttgatgtggaaccaaatctgatttgagaaccaagtt

SEQ ID NO: 963 - DNA, 674 bp, Artificial
  Glycine max FAD3A mutation created with TALEN pair GmFAD3_T01.1
cactgctttgttatgcctacctcatttcatttggctttagacaacttaaatttgagatctttattatgttttgttcttatatggtaaagtgattcattcttcacatttcctcaattcttgtgccataccatggatggttagttcatcccggctttttttgtttgtcattggaagttcttttattgattcaatttttatagcgtgttcggaacgcgttttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgattgagaaccaagttgattttgatggattttgcaggagaattagccacagaactcaccatcaaaatcatggacacattgagaaggatgaatcctgggttccagtatgtgattaactacttcctctatagttatttttgattcaattaatttatttatttaataagttcaagaaaaaatggaatctttatacttcagataaagctagtcttgaacatttttttttgtcattatctagtttaaccgagaag

SEQ ID NO: 964 - DNA, 722 bp, Artificial
  Glycine max FAD3A mutation created with TALEN pair GmFAD3_T01.1
  misc_feature (687): n is a or c or t or g
cactgctttgttatgcctacctcatttcatttggctttagacaacttaaatttgagatctttattatgttttttgcttatatggtaaagtgattcattcttcacattgaattgaacatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcatttgtcattgaaaagttctttttattaattatatttttattgcgtgtttggaatcccatttgagaaataagaaatcacgtttaaaaattgtgaaagttataactattaacttttgactaaacttgaaaaaatcacatttttgatgtggaaccaaatctgatttgagaaccaagttgattttgatggattttgcaggagaattagccacagaactcaccatcaaaaatcatggacacattgagaaggatgaatcctgggttccagtatgtgattaactacttcctctatagttatttttgattcaattaaaatttatttatttaataagttcaagaaaaaaagggaatctttntacttcagataaagctgttcttgaacatttttttt

SEQ ID NO: 965 - DNA, 731 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaggccatggaagcttttcagacagcccttttctaaatagcctggtgggacacatcttgcattcctcaattcttgtgccataccatggatggttagttcatcccggcttttttgtttgtcattggaagttcttttattgattcaattttatagcgtgttcggaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttattattaataagttcaagaaaaaggaatcttatacttcagataaagctgattcttgaacatttttttgtcattatcttagttaaccgag

SEQ ID NO: 966 - DNA, 502 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatattttattgcgtgtttggaatcccatttgagaataagaaatcacgtttaaaatgtgaaagttataactattaacttttgactaaacttgaaaaaatcacattttgatgtggaaccaaatctgatttgagaaccaag

SEQ ID NO: 967 - DNA, 452 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgttggcgatggccaccacctgctccggggtcaagccgtgggcctggcacagcaccggcaacagccgctggaccgtctccagcggccatggaagcttttcagacagcccttttctaaatagcctggtgggacacatcttgcattcctcaattcttgtgccataccatggatggttagttcatcccggctttttgtttgtcattggaagttcttttattgattcaatttttatagcgtgttcggaaaacgcgtttcagaaaataatgaaatacatcttgaatctgaaagttataacttttagcttcattgtcattgaaagttcttttattaattatattttt

SEQ ID NO: 968 - DNA, 815 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaacaggcccacggcttgaccccggagcaggtggtggccatcgccagccacgatggcggcaagcaggcgctggagacggtccagcggctatggccatggaagctttcagacagcccttttctaaatagcctggtgggacacatcttgcattcctcaattcttgtgccataccatggatggttagttcatcccggctttttgtttgtcattggaagttcttttattgattcaatttttatagcgtgttcggaaaacgcgtttcagaaaataatgaaatacatcttgaatctgaaagttataacttttagcttcattgtcattgaaagttcttttattaattatattttattgcgtgtttggaatcccatttgagaaataagaaatcacgtttaaaatgtgaaagttataactattaactttgactaaacttgaaaaattcacattttgatgtggaaccaaatctgatttgagaaccaagttgattttgatggattttgcaggagaattagccacagaactcaccatcaaaatcatggacacattgagaagggattgaatcctggggttccagtatgtgattaactacttcctctatagttatttttgattcaattaaatttatttatttaataagttcaagaaaaacggaatctttcatacttcagataaagctgttcttgaacatttttttcgtcattatctt

SEQ ID NO: 969 - DNA, 706 bp, Artificial
  Glycine max FAD3A mutation created with TALEN pair GmFAD3_T01.1
cactgctttgttatgcctacctcatttcatttggctttagacaacttaaatttgagatctttattatgttttttgttcttggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttcttttattaattatatttttaattgcgtgtttggaatcccatttgagaaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacattttttttagtcattatcttagttaaccgag

SEQ ID NO: 970 - DNA, 492 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgccatggaagcttttcagacagcccttttctaaaatagcctggtgggacacatcttgcattcctcaattcttgtgccataccatggatggttagttcatcccggcttttttgtttgtcattggaagttcttttattgattcaattttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaaattgtgaaagttataactattaacttttgactaaacttgaaaaaatcacatttttgatgtggaaccaaatctga

SEQ ID NO: 971 - DNA, 560 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgacatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatattttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgatttgatggattttgcaggagaattagccacagaactcaccatcaaaatcatgga

SEQ ID NO: 972 - DNA, 735 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcatttgtcattgaaaagttctttttattaattatatttttattgcgtgtttggaatcccatttgagaaataagaaatcacgtttaaaaatgtgaaagttataactattaacttttgactaaacttgaaaaaatcacatttttgatgtggaaccaaatctgattttgagaaccaagttgattttgatggattttgcaggagaattagccacagaactcaccatcaaaatcatggacacattgagaggatgaatcctgggttccagtatgtgattaactacttcctctatagttattttgattcaattaaatttatttatttaataagttcaagaaaaaaggaatctttatacttcagataaagctgattcttgaacatttttttgtcattatcttagttaaccg

SEQ ID NO: 973 - DNA, 687 bp, Artificial
  Glycine max FAD3A mutation created with TALEN pair GmFAD3_T01.1
cactgctttgttatgcctacctcatttcatttggctttagacaacttaaatttgagatctttattatgtttttttgcttatatggtaaagtgattcattcttcacattgaatccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaattgtgaaagttataactattaacttttgactaaacttgaaaaaatcacatttttgatgtggaaccaaatctgattttgagaaccaagttgattttgatggattttgcaggagaattagccacagaactcaccattcaaaatcatggacacattgagaaggattgaatcctgggttccagtatgtgattaactacttcctctatagttatttttgattcaattaaatttattttatttaataagttctaagaaaaaaagggaatcttttac

SEQ ID NO: 974 - DNA, 748 bp, Artificial
  Glycine max FAD3A mutation created with TALEN pair GmFAD3_T01.1
cactgctttgttatgcctacctcatttcatttggctttagacaacttaaatttgagatctttattatgtttttttgcttatatggtaaagtgattcattcttcacattgaattgaacagacagtggccatggaagcttttcagacagcccttttctaaatagcctggtgggacacatcttgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttcgtcattatctagttaaccg

SEQ ID NO: 975 - DNA, 712 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaggggtcaagccgtgggcctggcacagcaccggcaacagcgcctgcaccgtctccagcgcctgcttgccatggccatggaagcttttcagacagcccttttctaaatagcctggtgggacacatcttgcattcctcaattcttgtgccataccatggatggttagttcatcccggctttttgtttgtcattggaagttcttttattgattcaatttttatagcgtgttcggaaaacgcgtttcagaaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaactttgactaaacttgaaaaaattcacattttgatgtggaaccaaatctgatttgagaaccaaagttgattttgatggattttgcaggagaattagccacagaactcaccatcaaaatcatggacacattgagaaggatgaatcctgggttccagtatgtgattaactacttcctctatagttatttttgattcaattaaa

SEQ ID NO: 976 - DNA, 736 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgattttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacatttttttgtcattatcttagttaaccgag

SEQ ID NO: 977 - DNA, 751 bp, Artificial
  Glycine max FAD3A mutation created with TALEN pair GmFAD3_T01.1
cactgctttgttatgcctacctcatttcatttggctttagacaacttaaatttgagatctttattatgtttttttgcttatatggtaaagtgattcattcttcacattgaattgagtggccatggaagcttttcagacagcccttttctaaatagcctggtgggacacatcttgcattcctcaattcttgtgccataccatggatggttagttcatcccggctttttttgtttgtcattggaagttcttttattgattcaatttttatagcgtgttcggaaacgcgtttcagaaaataatgaaatacatcttgaatctgaaagttataactttttagcttcattgtcattgaaagttctttttatttaattatatttttattgcgtgtttggaatcccatttgagaaataagaaatcacgttttaaaaattgtgaaagttataactattaacttttgactaaacttgaaaaaatcacatttttgatgtggaaccaaatctgattttgagaaccaagttgattttgatggattttgcaggagaattagccacagaactcaccatcaaaatcatggacacatttgagaaaggattgaatcctgggttccagtatgtgattaactacttcctctatagttatttttgattcaattaaatttatttatttaataagttcaagaaaaaagggaatctttatacttcagataaagctgttcttgaacattttttttagtcattatcttagttaaccg

SEQ ID NO: 978 - DNA, 810 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaacagcggctgttgccggtgctgtgccaggcccacggcttgatcccggagcaggtggtggccatcgccagcaatattggtccatggaagcttttcagacagccctttttctaaatagcctggtgggacacatcttgcattcctcaattcttgtgccataccatggatggttagttcatcccggcttttttgtttgtcattggaagttcttttattgattcaatttttatagcgtgttcggaaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaatcatggacacattgagaaggatgaatcctgggttccagtatgtgattaactacttcctctatagttatttttgattcaattaaatttatttatttaataagttcaaggaaaaaagggaatctttatacttcagataaagctgttcttgaacattttttttagtcattattctag

SEQ ID NO: 979 - DNA, 765 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaatgacagcgacggtccctaacgctgccgggtgttggcttaacgcaacgatgtgcgcgtgtgtaaacccgtggccgaccagtgcctcgtggtgccatggaagcttttcagacagcccttttctaaatagcctggtgggacacatcttgcattcctcaattcttgtgccataccatggatggttagttcatcccggcttttttgtttgtcatggaagttcttttattgattcaatttttatagcgtgttcggaaacgcgtttcagaaaataatgaaatacatcttgaatctgaaagttataacttttagcttcattgtcattgaaagttcttttattaattatattttattgcgtgtttggaatcccattgagaataagaaatcacgtttaaaatgtgaaagttataactattaactttgactaaacttgaaaaatcacattttgatgtggaaccaaatctgatttgagaaccaagttgattttgatggatttgcaggagaattagccacagaactcaccattcaaaatcatggacacattgagaaggatgaatcctgggttccagtatgtgattaactacttcctctatagttatttttgattcaattaaatttatttatttaataagttcaagaaaaaggaatctttatac

SEQ ID NO: 980 - DNA, 735 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaagccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaaattgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaagggaatctttatacttcagataaagctgttcttgaacattttttttagtcattatcttag

SEQ ID NO: 981 - DNA, 745 bp, Artificial
  Glycine max FAD3A mutation created with TALEN pair GmFAD3_T01.1
cactgctttgttatgcctacctcatttcatttggctttagacaacttaaatttgagatctttattatgtttttttgcttatatggtaaagtgattcattcttcacattgaattgatggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaaattgtgaaagttataactattaacttttgactaaacttgaaaaaactcacattttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttattaataagttcaagaaaaagggaatctttatacttcagataaagctgttcttgaacattttttttagtcattatcttagttaaccgag

SEQ ID NO: 982 - DNA, 711 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgcatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaattgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaaggaatcttatacttcagataaagctgttcttgaacatttttttt

SEQ ID NO: 983 - DNA, 632 bp, Artificial
  Glycine max FAD3A mutation created with TALEN pair GmFAD3_T01.1
  misc_feature (473): n is a or c or t or g
cactgctttgttatgcctacctcatttcatttggctttagacaacttaaatttgagatctttattatgtttttttgcttatatggtaaagtgattcattcttcacattgaattgagtggccatggaagcttttcagacagcccttttctaaatagcctggtgggacacatcttgcattcctcaattcttgtgccataccatggatggttagttcatcccggctttttgtttgtcattggaagttcttttattgattcaatttttatagcgtgttcggaaacgcgtttcagaaaataatgaaatacatcttgaatctgaaagttataactttttagcttcattgtcattgaaagttctttttattaattatatttttattgcgtgtttggaatcccatttgagaaataagaaatcacgtttaaaaatgtgaaagttataactattaacttttgactaaacttgaaaaaatcacnttttgaatgtggaaccaaatctgattttgagaaccaagttgaattttgatggttttgcaggagaattagccacaagaactcaccattcaaaatcatggactacattgagaaggatgaatcctgggttccagtatgtgattaactacttcctctatagtt

SEQ ID NO: 984 - DNA, 733 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaatttggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataactttttagcttcattgtcattgaaaagttctttttattaattatatttttattgcgtgtttggaatcccatttgagaaataagaaatcacgtttaaaattgtgaaagttataactattaacttttgactaaacttgaaaaaatcacatttttgatgtggaaccaaatctgattttgagaaccaagttgattttgatggattttgcaggaaaattagccacagaactcaccatcaaaatcatggacacattgagaaggatgaatcctgggttccagtatgtgattaactacttcctctatagttatttttgattcaattaaatttatttatttaataagttcaagaaaaaaggaatctttatacttcagataaagctgttcttgaacattttttttagtcattatcttag

SEQ ID NO: 985 - DNA, 778 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaggtcactatcagctagcaaatatttcttgtcaaaaacctctgacacatgcagctcccggacacggtcacagcttgtctgtaagcggatgccgggagcagacaagcccgtcagggcgcgtcagcgggtgttggtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaactgaaaaaatcacatttttgatgtggaaccaaatctgatttgagaaccaagttgattttgatggattttgcaggagaattagccacagaactcaccatcaaaatcatggacatcattgagaagggatgaaatcctgggttccagtatgtgattaactacttcctctatagttatttttgattcaattaattta

SEQ ID NO: 986 - DNA, 726 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacatcatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaactcacatttttgatgtggaaccaaatctgattttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttattaataagttcaagaaaaagggaatcttatacttcagataaagctgttcttgaacatttttttagtcattatcttagttaaccga

SEQ ID NO: 987 - DNA, 706 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaacagtgggcctggcacagcaccggcaacagcgcctgcaccgtctccagcgcctgcttgccaccgccattgctggcgatggccaccacctgctggggggtcaagccgtgggcctggcacagcaccggcaacagccgctggaggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttcttttattaattatatttttattgcgtgtttggaatcccatttgagaaataagaaatcacgtttaaaatgtgaaagttataactattaactttgactaaacttgaaaaaatcacatttttgatgtggaaccaaatctgatttgagaaccaagttgattttgatggattttgcaggagaattagccacagaactcaccatcaaaatcatggaca

SEQ ID NO: 988 - DNA, 733 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgattttgagaaccaagtttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaaggaatcttatacttcagataaagctgttcttgaacattttttttgtcattatcttagttaa

SEQ ID NO: 989 - DNA, 470 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaatatggaagcttttcagacagcccttttctaaatagcctggtgggacacatcttgcattcctcaattcttgtgccataccatggatggttagttcatcccggctttttgtttgtcattggaagttcttttattgattcaatttttatagcgtgttcggaaacgcgtttcagaaaataatgaaatacatcttgaatctgaaagttataacttttagcttcattgtcattgaaaagttcttttattaattatattttcattgcgtgtttggaatcccatttgagaaataagaaatcacgtttaaaaattgtgaaatgttataactattaacttttgactaaacttgaaaaaactcacattttt

SEQ ID NO: 990 - DNA, 660 bp, Artificial
  Glycine max FAD3A mutation created with TALEN pair GmFAD3_T01.1
cactgctttgttatgcctacctcatttcatttggctttagacaacttaaatttgagatctttattatgtttttttgcttatatggtaaagtgattcattcttcacattgaatcagtccatggaagcttttcagacagcccttttctaaatagcctggtgggacacatcttgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcatttgaaagttcttttattaattatattttttattgcgtgtttggaatcccatttgagaaataagaaatcacgtttaaaatgtgaaagttataactattaacttttgactaaaacttgaaaaaaactcacatttttgatgtggaaccaaatctgatttgagaaccaagttgattttgatggattttgcaggagaattagccacagaactcaccatcaaaatcatggacacattgagaaggatgaatcctgggtttccagtatgtgattaacctacttccctctatagttattttttgattcaattaaatttatttt

SEQ ID NO: 991 - DNA, 717 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataactttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgattcttgaacatttttttt

SEQ ID NO: 992 - DNA, 714 bp, Artificial
  Glycine max FAD3A mutation created with TALEN pair GmFAD3_T01.1
  misc_feature (676): n is a or c or t or g
cactgctttgttatgcctacctcatttcatttggctttagacaacttaaatttgagatctttattatgttttttgcttatatggtaaagtgattcattcttcacattgaattgatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaattgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgtattcaattaaatttatttattaataagtcaagaaaaaagggaatctttntacttcagataaagctgtcttgaacattttttttagtc

SEQ ID NO: 993 - DNA, 642 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgattttgagaaccaagttgattttgatggattttgcaggagaattagccacagaactcaccatcaaaatcatggacacattgagaaggatgaatcctgggttccagtatgtgattaactacttcctctatagttatttttgattcaattaaattta

SEQ ID NO: 994 - DNA, 732 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattggccatggaagcttttcagacagcccttttctaaatagcctggtgggacacatcttgcattcctcaattcttgtgccataccatggatggttagttcatcccggctttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatattttattgcgtgtttggaatcccatttgagaaataagaaatcacgtttaaaattgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcattaaatttattattaatagttcaagaaaaaggaatcttatacttcagataaagctgttcttgaacatttttttagtcattatcttagttaaccgag

SEQ ID NO: 995 - DNA, 740 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgggccatggaagcttttcagacagcccttttctaaatagcctggtgggacacatcttgcattcctcaattcttgtgccataccatggatggttagttcatcccggcttttttgtttgtcattggaagttcttttattgattcaattttatagcgtgttcggaaacgcgtttcagaaaataatgaaatacatcttgaatctgaaagttataacttttagcttcattgtcattgaaagttctttttattaattatattttattgcgtgtttggaatcccatttgagaaataagaaatcacgtttaaaaattgtgaaagttataactattaacttttgactaaacttgaaaaaactcacatttttgatgtggaaccaaatctgatttgagaaccaagttgattttgatggattttgccaggagaattagccacagaactcaccatcaaaatcatggacacattgagaaggatgaatcctgggttccagtatgtgattaactacttcctctatagttatttttggattcaattaaatttatttatttaataagttcaagaaaaaagggaatctttatacttcagataaagctgttcttgaacatttttttagtcattatcttagtaaccgag

SEQ ID NO: 996 - DNA, 710 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaggaatctttatacttcagataaagctgttcttgaacattttttttgtcattatcttagttaaccgagaa

SEQ ID NO: 997 - DNA, 723 bp, Artificial
  Glycine max FAD3A mutation created with TALEN pair GmFAD3_T01.1
cactgctttgttatgcctacctcatttcatttggctttagacaacttaaatttgagatctttattatgtttttgttcttatatggtaaagtgattcattcttcacattgaattgccagcaatattggtctggggggtcaagccgtgggcctggcacagcaccggcaacagccgctggaccgtctccagcgcctgcttgccaccgtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaactcacatttttgatgtggaaccaaattctgatttgagaaccaagttgattttgatggattttgcagagaattagccacagaactcaccatcaaaatcatggacacattgagaagggatgaatcctgggttccagtatgtgattaactacttcctctatagttatttttt

SEQ ID NO: 998 - DNA, 710 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacatcatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttctttttattaattatatttttattgcgtgtttggaatcccatttgagaaataagaaatcacgtttaaaattgtgaaagttataactattaacttttgactaaacttgaaaaaactcacatttttgatgtggaaccaaatctgattttgagaaccaagttgattttgatggattttgcaggagaattagccacagaactcaccatcaaaatcatggacacattgagaaggatgaatcctgggttccagtatgtgattaactacttcctctatagttatttttggattcaattaaatttatttatttaataagttcaagaaaaagggaatcttatacttcagataaagctgttcttgaacatttttttt

SEQ ID NO: 999 - DNA, 692 bp, Artificial
  Glycine max FAD3A mutation created with TALEN pair GmFAD3_T01.1
cactgctttgttatgcctacctcatttcatttggctttagacaacttaaatttgagatctttattatgtttttttgcttatatggtaaagtgattcattcttcacattgaattgaacaagattgcaaaacgtggcggcgtgaccgcagtggaggcagtgcatgcatggcgcaatgcactgacgggtgccccgctcaacttgaccccccagcaggtgatggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgttttcagaaataattgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaactcacatttttgatgtggaaccaaattctgatttgagaaccaagttgatttttgatggattttggcaggagaattagcccacagaactcaccatcaaaatcatggacacattgagaagggatg

SEQ ID NO: 1000 - DNA, 736 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgattttgagaaccaagttgattttgatggattttgcaggagaattagccacagaactcaccatcaaaatcatggacacattgagaaggatgaatcctgggttccagtatgtgattaactacttcctctatagttattttgattcaattaaatttattattaataagttcaagaaaaaaggaatctttatacttcagataaagctgttcttgaacattttttttgtcattatcttagttaaccgag

SEQ ID NO: 1001 - DNA, 551 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttataattatatttttatttgcgtgttcggaatcccatttgagaaataagaaatcacgtttaaaatgtgaaagttataactattaacttttgactaaacttgaaaaaatcacattttgatgtggaaccaaatctgatttgagaaccaagttgatttgatggattttgcatggagaattagccacagaactcaccatt

SEQ ID NO: 1002 - DNA, 738 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaacaagattgcaaaacgtggcggcgtgaccgcagtggaggcagtgcatgcatggcgcaatgcactgacgggtgccccgctcaacttgaccccccagcaggtgatggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaataatgaaatacatcttgaatctgaaagttataacttttagcttcattgtcattgaaagttcttttattaattatatttttattgcgtgtttggaatcccatttgagaataagaaatcacgtttaaaatgtgaaagttataactattaacttttgactaaacttgaaaaaaatcacattttgatgtggaacaaatctgatttgagaaccaagttgatttgatggattttgcagagaattagccacagaactcaccatcaaaatcatggacacaattgagaagggatgaatcctgggttccagtatgtgattaactacttcctctatagttatttttgattcaatt

SEQ ID NO: 1003 - DNA, 645 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgattttgagaaccaagttgattttgatggattttgcaggagaattagccacagaactcaccatcaaaatcatggacacattgagaaggatgaatcctgggttccagtatgtgattaactacttcctctatagttatttttgattcaattaaatttattta

SEQ ID NO: 1004 - DNA, 703 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaagccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgttttaaaaattgtgaaagttataactattaacttttgactaaacttgaaaaaatcacatttttgatgtggaaccaaatctgatttgagaaccaagttgattttgatggattttgcaggagaattagccacagaactcaccatcaaaattcatggacacattgagaaggatgaatcctgggttccagtatgtgattaactacttcctctatagttattttgattcaattaaatttatttattaataagttcaagaaaaaaggaatctttatacttcagataaagctgtt

SEQ ID NO: 1005 - DNA, 548 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttcttttataattatattttattgcgtgtttggaatcccatttgagaaattaagaaatcacgttttaaaaatgtgaaagttataatctattaacttttgactaaaactttgaaaaaatcaacatttttgaatgtggaaccaaatctgattttgagaaccaagttagaattttgatggattttgcatggagaattagccac

SEQ ID NO: 1006 - DNA, 648 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcatttgtcattgaaagttcttttattaattatattttattgcgtgtttggaatcccatttgagaaataagaaatcacgtttaaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttattta

SEQ ID NO: 1007 - DNA, 732 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttattaataagttcaagaaaaaggaatctttatacttcagataaagctgttcttgaacattttttttagtcattatcttagttaaccgag

SEQ ID NO: 1008 - DNA, 746 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataactttttagcttcattgtcattgaaagttctttttattaattatatttttattgcgtgtttggaatcccatttgagaaataagaaatcacgtttaaaatgtgaaagttataactattaacttttgactaaactttgaaaaaatcacatttttgaatgtggaaccaaatctgattttgagaaccaagttgaattttgatggattttgcatggagaattagccacagaactcaccattcaaaatcatggacacattgagaaggatgaatcctgggttccagtatgtgattaactacttcctctatagttatttttgattcaattaaatttatttatttaataagttcaagaaaaaaggaatcttatacttcagataaagctgttcttgaacatttttttgtcattatcttagttaaccgagaag

SEQ ID NO: 1009 - DNA, 449 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaagaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatattttcattgcgtgtttggaatcccatttgagaaataagaaatcacgtttaaaattgtgaaagttataactattaacttttgactaaa

SEQ ID NO: 1010 - DNA, 623 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcttgaaaagttcttttattaattatatttttattgcggtttggaatcccatttgagaaataagaaatcatcgtttaaaaattgtgaaagttataactattaacttttgactaaaacttgaaaaaactcacatttttgatgtggaaccaaatctgattttgagaaccaagttgatttgatggatttgcaggagaattagccacagaactcaccatcaaaatcatggacacattgagaaggatgaatcctgggttccagtatgtgattaactacttcctctatag

SEQ ID NO: 1011 - DNA, 626 bp, Artificial
  Glycine max FAD3A mutation created with TALEN pair GmFAD3_T01.1
cactgctttgttagcctacctcatttcatttggctttagacaacttaaatttgagatctttattatgttttttgcttatatggtaaagtgattcattcttcacattgaattgaacatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatattttcattgcgtgtttggaatcccatttgagaaataagaaatcacgtttaaaattgtgaaagttataactattaacttttgactaaatcttgaaaaaactcacatttttgatgtggaaccaaatctgattttgagaaccaagttgatttgatggattttgcaggagaattagccacagaactcaccatcaaaagtcatggacacattgagaaggatgaatcctgggttccagtatgtgattaactacttcctctatagtta

SEQ ID NO: 1012 - DNA, 731 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacatggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaaattgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttattattaataagttcaagaaaaagggaatcttatacttcagataaagctgttcttgaacattttttttagtcattatcttagttaaccgag

SEQ ID NO: 1013 - DNA, 495 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaatcaccggcaacagccgctggaccgtctccagcgcctgcttgccgccatcgtggctggcgatggccaccacctgctccggggtcaatggccatggaagcttttcagacagcccttttctaaatagcctggtgggacacatcttgcattcctcaattcttgtgccataccatggatggttagttcatcccggctttttgtttgtcatggaagttcttttattgattcaatttttatagcgtgttcggaaaacgcgtttcagaaaataatgaaatacatcttgaatctgaaagttataacttttagctcattgtcattgaagttcttttattaattatatttttattgcgtgtttggaatcccatttgagaaataagaaatcacgttt

SEQ ID NO: 1014 - DNA, 486 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaacaggtatccggtaagcggcagggtcggaacaggagagcgcacgagggagcttccagggggaaacgcctggtatctttatagtcctgtaatggaagcttttcagacagcccttttctaaatagcctggtgggacacatcttgcattcctcaattcttgtgccataccatggatggttagttcatcccggcttttttgttgtcattggaagttcttttattgattcaattttatagcgtgttcggaaaacgcgtttcagaaaataatgaaaatacatcttgaatctgaaagttataacttttagcttcattgtcattgaaagttcttttattaattatatttttattgcgtgtttggaatcccattgagaaat

SEQ ID NO: 1015 - DNA, 740 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaattgtgaaagttataactattaactttttgactaaacttgaaaaaactcacatttttgatgtggaaccaaatctgatttgagaaccaagttgattttgatggattttgcaggagaattagccacagaactcaccatcaaaattcatggacacattgagaaggatgaatcctgggttccagtatgtgattaactacttcctctatagttatttttgattcaattaaatttattatttaataagttcaagaaaaaggaatctttatacttcagataaagctgttcttgaacattttttttagtcattatcttagttaaccgag

SEQ ID NO: 1016 - DNA, 845 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaacagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccagtggccatggaagcttttcagacagcccttttctaaatagcctggtgggacacatcttgcattcctcaattcttgtgccataccatggatggttagttcatcccggcttttttgtttgtcattggaagttctttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaaacttgaaaaaaactcacatttttgatgtgggaaccaaaatctgattgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaag

SEQ ID NO: 1017 - DNA, 684 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacatttttggccatggaagcttttcagacagcccttttctaaatagcctggtgggacacatcttgcattcctcaattcttgtgccataccatggatggttagttcatcccggcttttttgtttgtcattggaagttcttttattgattcaattttatagcgtgttcggaaacgcgttcagaaaaataatgaaatacatcttgaatctgaaagttataacttttagcttcattgtcattgaaagttcttttattaattatattttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgatttgaatggattttgcaggagaattagccacagaactcacatcaaaatcatggacacattgagaaggatgaatcctgggttccagtatgtgataactacttcctctatagttatttttgattcaattaaatttatttattaataagttcaagaaaaaaggaatcttatacttcagataaag

SEQ ID NO: 1018 - DNA, 637 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaacagcaccggcaacagccgctggaccgtctccagcgcctgcttgccaccgccattgctggcgatggccaccacctgctggccatggaagctttttcagacagcccttttctaaatagcctggtgggacacatcttgcattcctcaattcttgtgccataccatggatggttagttcatcccggcttttttgtttgtcattggaagttcttttattgattcaattttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaattcacgtttaaatgtgaaagttataactattaacttttgactaaacttgaaaaatcacattttgatgtggaaccaaatctgatttgagaaccaagttgattttgatgggattttgcagggagaatttagccacagaactcaccatcaaaa

SEQ ID NO: 1019 - DNA, 784 bp, Artificial
  Glycine max FAD3A mutation created with TALEN pair GmFAD3_T01.1
  misc_feature (735): n is a or c or t or g
cactgctttgttatgcctacctcatttcatttggctttagacaacttaaatttgagatctttattatgtttttttgcttatatggtaaagtgattcattcttcacattgaattgaacttgccaccgccattgctggcgatggccaccacctgctggggggtcaagccgtgggcctggcacagcaccggcagtggccatggaagctttttcagacagcccttttctaaatagcctggtgggacacatcttgcattcctcaattcttgtgccataccatggatggttagttcatcccggcttttttgtttgtcattggaagttctttttattgattcaatttttatagcgtgttcggaaaacgcgtttcagaaaataatgaaaatacatcttgaatctgaaagttataactttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacatttgagaaggatgaatcctgggtttccagtatgtgattaactacttcctctatagtttatttttgattcaattaaatttatttntttaataagttcaagaaaaaagggaatctttatacttcagataaagctg

SEQ ID NO: 1020 - DNA, 744 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaacagacagtggccatggaagcttttcagacagcccttttctaaatagcctggtgggacacatcttgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttgtcattatctagttaacc

SEQ ID NO: 1021 - DNA, 624 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaacaagattgcaaaacgtggcggcgtgaccgcagtggaggcagtgcatgcatggcgcaatgcactgacgggtgccccgctcaacttgaccccccagcaggtgatggccgcatggaagcttttcagacagcccttttctaaatagcctggtgggacacatcttgcattcctcaattcttgtgccataccatggatggttagttcatcccggctttttgtttgtcattggaagttctttattgattcaatttttatagcgtgttcggaaacgcgtttcagaaaataatgaaatacatcttgaatctgaaagttataacttttagcttcattgtcattgaaagttctttattaattatatttttattgcgtgtttggaatcccatttgagaaataagaaatcacgtttaaaatgtgaaagttataactattaactttgactaaacttgaaaaaaactcacatttttgatgtgggaaccaaattctgatttgagaaccaagttgattttgatgga

SEQ ID NO: 1022 - DNA, 734 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacatcatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgttttaaaaatgtgaaagttataactattaacttttgactaaacttgaaaaaatcacatttttgatgtggaaccaaatctgattttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaagggaatctttatacttcagataaagctgattcttgaacattttttttgtcattatcttagttaaccgagaag

SEQ ID NO: 1023 - DNA, 742 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgatggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataactttttagcttcattgtcattgaaagttctttttattaattatatttttattgcgtgtttggaatcccatttgagaaataagaaatcacgtttaaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaaagggaatctttatacttcagataaagctgttcttgaacattttttttgtcattatcttagttaaccgag

SEQ ID NO: 1024 - DNA, 738 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataactttttagcttcattgtcattgaaagttctttttattaattatatttttattgcgtgtttggaatcccatttgagaaataagaaatcacgtttaaaaatgtgaaagttataactattaacttttgactaaacttgaaaaaatcacatttttgatgtggaaccaaatctgatttgagaaccaagttgattttgatggattttgccaggagaattagccacagaactcaccatcaaaatcatggacacattgagaaggatgaatcctgggttccagtatgtgattaactacttcctctatagttattttgattcaattaaatttatttattaataagttcaagaaaaaggaatctttatacttcagataaagctgattcttgaacatttttttgtcattatcttagttaaccgag

SEQ ID NO: 1025 - DNA, 705 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgatggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaaatgtgaaagttataactattaacttttgactaaaacttgaaaaaatcacatttttgatgtggaaccaaatctgattttgagaaccaagtttgaattttgatggattttgcaggagaattagccacagaactcaccatcaaaatcatggacacattgagaaggatgaatcctgggttccagtatgtgattaactacttcctctatagttatttttgattcaattaaatttatttattaataagttcaagaaaaaaaggaatctttatacttcagataaagctg

SEQ ID NO: 1026 - DNA, 593 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgatggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcagtgtttggaatcccatttgagaaataagaaatcacgtttaaatgtgaaagttataactattaacttttgactaaaacttgaaaaaatcacatttttgatgtggaaccaaatctgatttgagaaccaagttgaatttgatggattttgcaggagaattagccacagaactcaccattcaaaatcatggacacattgagaaggattgaatcctggg

SEQ ID NO: 1027 - DNA, 695 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataactttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttattaataagttcaagaaaaaaggaatctttatacttcagataaagctg

SEQ ID NO: 1028 - DNA, 739 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataactttttagcttcattgtcattgaaagttctttttattaattatattttattgcgtgtttggaatcccatttgagaaataagaaatcacgtttaaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaagggaatctttatacttcagataaagctgattcttgaacattttttttgtcattatcttagttaaccgag

SEQ ID NO: 1029 - DNA, 683 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaccatggaagcttttcagacagcccttttctaaatagcctggtgggacacatcttgcattcctcaattcttgtgccataccatggatggttagttcatcccggctttttttgtttgtcattggaagttcttttattgattcaatttttatagcgtgttcggaaacgcgtttcagaaaataatgaaatacatcttgaatctgaaagttataaacttttagcttcattgtcattgaaaagttcttttattaattatatttttattgcgtgtttggaatcccatttgagaaataagaaatcacgtttaaaaatgtgaaagttataactattaacttttgactaaaacttgaaaaaatcacatttttgatgtggaaccaaaattctgatttgagaaccaagtttgaattttgatggattttgcatggagaattagccaacagaactcaccattcaaaaatcatggacacattgagaaggattgaatcctgggattccagtatgtgattaactacttcctctatagttattttgattcaattaaatttatttattaataagttcaagaaaaaaa

SEQ ID NO: 1030 - DNA, 516 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtcaagccgtggccatggaagcttttcagacagcccttttctaaatagcctggtgggacacatcttgcattcctcaatcttgtgccataccatggatggttagttcatcccggcttttttgtttgtcattggaagttcttttattgattcaatttttatagcgtgttcggaaactgcgtttcagaaataatgaaatacatcttgaatctgaaagttataacttttagcttcattgtcattgaaagttcttttattaattatatttttattgcgtgtttggaatcccatttgagaaataagaaatcacgtttaaaattgtgaaagttataactattaactttgactaaacttgaaaaaatcacattttgatgtggaaccaaatctgatttgagaaccaagttgattttgatggatttttgcaggagaattaaga

SEQ ID NO: 1031 - DNA, 722 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaatggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataactttttagcttcattgtcattgaaagttctttttattaattatatttttattgcgtgtttggaatcccatttgagaaataagaaatcacgtttaaaattgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagtttcaagaaaaaagggaatctttatacttcagataaagctgttcttgaacatttttttt

SEQ ID NO: 1032 - DNA, 630 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgatggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaaattgtgaaagttataactattaacttttgactaaacttgaaaaaactcacatttttgatgtggaaccaaatctgatttgagaaccaagttgatttgatggattttgcaggagaattagccacagaactcaccatcaaaagtcatggacacattgagaaggatgaatcctgggttccagtatgtgattaactacttcctctatagtta

SEQ ID NO: 1033 - DNA, 742 bp, Artificial
  Glycine max FAD3A mutation created with TALEN pair GmFAD3_T01.1
cactgctttgttagcctacctcatttcatttggctttagacaacttaaatttgagatctttattatgttttttgcttatatggtaaagtgattcattcttcacattgaattgaacatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaagttataacttttagcttcattgtcattgaaagttctttttattaattatatttttattgcgtgtttggaatcccatttgagaaataagaaatcacgtttaaaaattgtgaaagttataactattaacttttgactaaacttgaaaaaactcacatttttgatgtggaaccaaatctgatttgagaaccaagttgattttgatggattttgcaggagaattagccacagaactcaccatcaaaagtcatggacacattgagaaggatgaatcctgggttccagtatgtgattaactacttcctctatagttattttgattcaattaaatttatttatttaataagttcaagaaaaaagggaaatctttatacttcagataaagctgttcttgaacattttttttagtcattatcttagttaaccgag

SEQ ID NO: 1034 - DNA, 702 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtatggaagcttttcagacagcccttttctaaatagcctggtgggacacatcttgcattcctcaattcttgtgccataccatggatggttagttcatcccggcttttttgtttgtcattggaagttcttttattgattcaattttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaatgtgaagttataactattaacttttgactaaacttgaaaaaatcacattttgatgtggaaccaaatctgatttgagaaccaagttgattttgatggattttgcaggagaattagccacagaactcaccatcaaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacattttttttgtcattatcttagttaaccgag

SEQ ID NO: 1035 - DNA, 671 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacatcatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaaatgtgaaagttataactattaacttttgactaaacttgaaaaaactcacatttttgatgtggaaccaaatctgattttgagaaccaagttgaattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaaggaatc

SEQ ID NO: 1036 - DNA, 730 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaatcagtccatggaagcttttcagacagcccttttctaaatagcctggtgggacacatcttgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaaatgtgaaagttataactattaacttttgactaaacttgaaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagtatttttgattcaattaaatttatttatttaataaagttcaagaaaaaatggaaatctttatacttcagataaagctgttcttgaacattttttttgtcattatct

SEQ ID NO: 1037 - DNA, 716 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaaattgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaagggaatctttatacttcagataaagctgttcttgaacatttttttt

SEQ ID NO: 1038 - DNA, 749 bp, Artificial
  Glycine max FAD3A mutation created with TALEN pair GmFAD3_T01.1
cactgctttgttatgcctacctcatttcatttggctttagacaacttaaatttgagatctttattatgtttttttgcttatatggtaaagtgattcattcttcacattgaattgacaccgccattgctggcgatggccaccacctgctggggggtcaagccgtgggcctggcacagcaccggcaacagccgctggaccgtctccagcgcctgcttgccgccatcgccccatggaagctttttcagacagcccttttctaaatagcctggtgggacacatcttgcattcctcaattcttgtgccataccatggtggttagttcatcccggctttttttgtttgtcattggaagttcttttattgattcaatttttatagcgtgttcggaaacgcgtttcagaaataatgaatacatcttgaatctgaaagttataacttttagcttcattgtcattgaaagttcttttattaattatatttttattgcgtgtttggaattcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggaacacattgagaagggatgaatcctgggttccagtatgtgattaactacttcctctatagttatttttgattcaa

SEQ ID NO: 1039 - DNA, 752 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaatggcgatggccaccacctgctgaggggtcaagccgtgggcctggcacagcaccggtggccatggaagcttttcagacagcccttttctaaatagcctggtgggacacatcttgcattcctcaattcttgtgccataccatggatggttagttcatcccggctttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacatttgagaaggatgaatcctgggttccagtatgtgattaactacttcctctatagttatttttgattcaattaaatttatttatttaataagttcaagaaaaaagggaatctttatacttcagataaagc

SEQ ID NO: 1040 - DNA, 588 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaatgccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcatttgtcattgaaagttctttttattaattatattttattgcgtgtttggaatcccatttgagaaattaagaaatcacgtttaaaatgtgaaagttataactattaacttttgactaaacttgaaaaaactcacatttttgatgtggaaccaaatctgattttgagaaccagttgatttgatggattttgcaggagaattagccacagaactcaccatcaaaatcatggacacattgagaaggattgaatcctggg

SEQ ID NO: 1041 - DNA, 662 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggaagcttttcagacagcccttttctaaatagcctggtgggacacatcttgcattcctcaattcttgtgccataccatggatggttagttcatcccggcttttttgtttgtcattggaagttcttttattgattcaattttttatagcgtgttcggaaacgcgtttcagaaataatgaaatacatcttgaatctgaaagttataacttttagcttcattgtcattgaaaagttctttattaattatatttttaattgcgtgtttggaatcccatttgagaaatagaaatcacgtttaaatgtgaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaatgggaatctttatacttcagataaagctgttc

SEQ ID NO: 1042 - DNA, 738 bp, Artificial
  Glycine max FAD3A mutation created with TALEN pair GmFAD3_T01.1
  misc_feature (679): n is a or c or t or g
cactgctttgttatgcctacctcatttcatttggctttagacaacttaaatttgagatctttattatgttttttgcttatatggtaaagtgattcattcttcacattgaattgacatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgattttgagaaccaagttgattttgatggattttgcaggagaattagccacagaactcaccattcaaaatcatggacacattgagaaggattgaatcctgggttccagtatgtgattaactacttcctctatagttattttgattcaattaaatttatttattaataagtcaagaaaaaaggaatctttntacttcagataaagctgttcttgaacattttttttgtcattatcttagtaaccgagaag

SEQ ID NO: 1043 - DNA, 596 bp, Artificial
  Glycine max FAD3A mutation created with TALEN pair GmFAD3_T01.1
cactgctttgttatgcctacctcatttcatttggctttagacaacttaaatttgagatctttattatgtttttttgcttatatggtaaagtgattcattcttcacattgaattgagtggccatggaagcttttcagacagcccttttctaaatagcctggtgggacacatcttgcattcctcaattcttgtgccataccatggatggttagttcatcccggctttttttgtttgtcattggaagttcttttattgattcaatttttatagcgtgttcggaaacgcgtttcagaaaataatgaaatacatcttgaatctgaaagttataactttttagcttcattgtcattgaaagttctttttattaattatatttttattgcgtgtttggaatcccatttgagaaataagaaatcacgtttaaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctggg

SEQ ID NO: 1044 - DNA, 561 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaacagggattgggggatcctatcagccgttcccagctggtgaagtccgagctggaggagaagaaatccgaagccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaaacgcgtttcagaaaataatgaaatacatcttgaatctgaaagttataacttttagcttcattgtcattgaaagttcttttattaattatatttttattgcgtgtttggaatcccatttgagaaataagaaattcacgtttaaaatgtgaaagttataactattaactttgactaaacttgaaaaaagtcacattttgatgtggaaccaaatcga

SEQ ID NO: 1045 - DNA, 639 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaaattgtgaaatgttataactattaacttttgactaaacttgaaaaaactcacatttttgatgtggaaccaaatctgatttgagaaccaagttgatttgatggattttgcaggagaattagccacagaactcaccattcaaaatcatggacacattgagaaggatgaatcctgggattccagtatgtgattaactacttcctctatagttatttttgg

SEQ ID NO: 1046 - DNA, 728 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaattgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttattaataagttcaagaaaaaggaatcttatacttcagataaagctgttcttgaacattttttttagtcattatcttagttaaccgag

SEQ ID NO: 1047 - DNA, 731 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgtggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatattttattgcgtgtttggaatcccatttgagaaataagaaatcacgtttaaaaatgtgaaagttataactattaacttttgactaaacttgaaaaaatcacatttttgatgtggaaccaaatctgattttgagaaccaagttgattttgatggattttgcaggagaattagccacagaactcaccatcaaaatcatggacacattgagaaggatgaatcctgggttccagtatgtgattaactactttcctctatagttattttgattcaattaaatttatttattaataagttcaagaaaaaaggaatctttatacttcagataaagctgattcttgaacattttttttgtcattatcttagttaacgag

SEQ ID NO: 1048 - DNA, 683 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttatttaattatattttttatttgcgtgttttggaaatcccatttgagaaataagaaatcacgtttaaaattgtgaaagttataactattaacttttgactaaacttgaaaaaatcacatttttgatgtggaaccaaatctgattttgagaaccaagttgaattttgatggattttgcaggagaattagccacagaactcaccatcaaaatcatggacacattgagaaggattgaatcctgggttccagtatgtgattaactacttcctctatagttatttttgattcaattaaatttatttattaataagttcaagaaaaaggaatc

SEQ ID NO: 1049 - DNA, 670 bp, Artificial
  Glycine max FAD3A mutation created with TALEN pair GmFAD3_T01.1
cactgctttgttatgcctacctcatttcatttggctttagacaacttaaatttgagatctttattatgtttttttgcttatatggtaaagtgattcattcttcacattgaattgaacagtggccataccatggatggttagttcatcccggcttttttgtttgtcattggaagttcttttattgattcaattttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacatttttttttgtcattattcttagttaacc

SEQ ID NO: 1050 - DNA, 555 bp, Artificial
  Glycine max FAD3A mutation created with TALEN pair GmFAD3_T01.1
  misc_feature (486): n is a or c or t or g
cactgctttgttatgcctacctcatttcatttggctttagacaacttaaatttgagatctttattatgttttttgcttatatggtaaagtgattcattcttcacattgaattgaccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatattttattgcgtgtttggaatcccatttgagaaataagaaatcacgtttaaaattgtgaaagtataactattaactttgactaaactgaaaaaactcacatttttgatgtggaaccaaanctgattttgagaaccagttgatttgatggattttgcaggagaattagccacagaactcaccatcaaaat

SEQ ID NO: 1051 - DNA, 778 bp, Artificial
  Glycine max FAD3A mutation created with TALEN pair GmFAD3_T01.1
cactgctttgttatgcctacctcatttcatttggctttagacaacttaaatttgagatctttattatgttttttcgcttatatggtaaagtgattcattcttcacattgaattgaacaggcatcgtggctggcgatggccaccacctgctccggggtcaagccgtgggcctggcacagcaccggcaacagccgctggaccgtctccagcgcctgtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatattttttattgcgtgtttggaatcccatttgagaaataagaaatcacgtttaaaatgtgaaagttataactattaacttttgactaaacttgaaaaaaatcacatttttgatgtgggaaccaaaattctgatttgagaaccaagttgattttgatggattttgcaggagaattagccacagaactcaccatcaaaatcatggacacattgagaagggatgaatcctgggttccagtatgtgattactacttcctctatagtttattttttggatttcaatttaaatttttattttatttaataagttcaag

SEQ ID NO: 1052 - DNA, 471 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaacacctgctggggggtcaagccgtgggcctggcacagcaccggcaacagccgctggaccgtctccagcgcctgcttgccaccgccattgctggcgatggccaccacctgctgggggggtcaagccgtgggcctggcacagcaccggggccatggaagcttttcagacagcccttttctaaatagcctggtgggacacatcttgcattcctcaattctttgtgccataccatggatggttagttcatcccggctttttgtttgtcattggaagttcttttattgattcaatttttatagcgtgttcggaaacgcgtttcagaaataatgaaatacatcttgaatctgaaagttataac

SEQ ID NO: 1053 - DNA, 716 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaaattgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaaggaatctttatacttcagataaagctgttcttgaacattttttt

SEQ ID NO: 1054 - DNA, 715 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgacatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaaagggaatctttatacttcagataaagctgttcttgaacatttttttt

SEQ ID NO: 1055 - DNA, 734 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttcttttattaattatatttttattgcgtgtttggaatcccatttgagaaataagaaatcacgtttaaaaatgtgaaagttataactattaacttttgactaaacttgaaaaaatcacattttgatgtggaaccaaatctgattttgagaaccaagttgaattttgatggattttgcatggagaattagccacagaactcaccatcaaaatcatggacacattgagaaggatgaatcctgggttccagtatgtgattaactacttcctctatagttattttgattcaattaaatttatttatttaataagttcaagaaaaaaaggaatctttatacttcagataaagctgattcttgaacatttttttgtcattatcttagttaaccgagaag

SEQ ID NO: 1056 - DNA, 780 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaatcaccggcaacagccgctggaccgtctccagcgcctgcttgccgccatcgtggctggcgatggccaccacctgctccggggtcaatggccatggaagcttttcagacagcccttttctaaatagcctggtgggacacatcttgcattcctcaattcttgtgccataccatggatggttagttcatcccggcttttttgtttgtcattggaagttctttttattgattcaatttttatagcgtgttcggaaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaaagttgattttgatggattttgcaggagaattagccacagaactcaccatcaaatcatggacacattgagaaggatgaatcctgggttccagtatgtgattaactacttcctctatagttatttttgattcaattaaattttatttatttaataagttcaagaaaaaaggaatctttatactttcagataaag

SEQ ID NO: 1057 - DNA, 737 bp, Artificial
  Glycine max FAD3A mutation created with TALEN pair GmFAD3_T01.1
  misc_feature (683): n is a or c or t or g
cactgctttgttatgcctacctcatttcatttggctttagacaacttaaatttgagatctttattatgttttttgcttatatggtaaagtgattcattcttcacattgaattgtggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaaattatatttttcattgcgtgtttggaatcccatttgagaaataagaaatcacgtttaaaattgtgaaagttataactattaacttttgactaaacttgaaaaaactcacatttttgatgtggaaccaaatctgattttgagaaccaagttgatttgatggattttgcaggagaattagccacagaactcaccatcaaaatcatggacacattgagaaggatgaatcctgggttccagtatgtgattaactacttcctctatagttatttttggatccaattaaaatttatttatttaataagttcaagaaaaaaagggaatctttntactcagataaatgctgttctgaacatttttttagtcattatcttagtaacgag

SEQ ID NO: 1058 - DNA, 726 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgagccatggaagcttttcagacagcccttttctaaatagcctggtgggacacatcttgcattcctcaattcttgtgccataccatggatggttagttcatcccggctttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttattaataagttcaagaaaaaggaatcttatacttcagataaagctgttcttgaacatttttttgtcattatcttag

SEQ ID NO: 1059 - DNA, 708 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaatggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagtttctttttattaattatatttttatttgcgtgtttggaatcccatttgagaaataagaaatcacgtttaaaatgtgaaagttataactattaacttttgactaaacttgaaaaaatcacatttttgatgtggaaccaaatctgattttgagaaccaagttgaattttgatggattttgcaggagaattagccaacagaactcaccatcaaaatcatggacacattgagaaggaatgaatcctgggttccagtatgtgattaactacttcctctatagttattttgattcaattaaatttatttattaataagttcaagaaaaaaaggaatctttatacttcagataaagctgtt

SEQ ID NO: 1060 - DNA, 638 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattggtatttcacaccgcatatggtgcactctcagtacaatctgctctgatgccgcatagttaagccagccccgacacccgccaacacccgctgacgcgccctgacgggcttgtctgctcccggcttccgcttacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaagtcacatttttgatgtggaaaccaaatctgatttgagaacc

SEQ ID NO: 1061 - DNA, 603 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaacacctgctggggggtcaagccgtgggcctggcacagcaccggcaacagccgctggaccgtctccagcgcctgcttgccaccgccattgctggcgatggccaccacctgctgggggggtcaagccgtgggcctggcacagcaccggggccatggaagcttttcagacagcccttttctaaatagcctggtgggacacatcttgcattcctcaattcttgtgccataccatggatggttagttcatcccggctttttgtttgtcattggaagttcttttattgattcaatttttatagcgtgttcggaacgcgttcagaaataatgaaatacatcttgaatctgaaagttataactttagcttcattgtcattgaaagttcttttataattatattttattgcgtgtttggaatcccatttgagtaataagaaatcacgatttaaatgtgaagttatactattaactttgactaaacttgaaaaatcaca

SEQ ID NO: 1062 - DNA, 704 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaatgtccagcgcctgcttgccaccgccattgctggcgatggccaccacctgctggggggtcaagccgtgggcctggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaatttagccacagaactcaccatcaaaatcatggacacatttgagaaggatgaatcctgggtttccagtatgtgattaactacttcctctatagttatttttgattc

SEQ ID NO: 1063 - DNA, 507 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaccctgcttgccaccattattgctggcgatggccaccacctgctggggggtcaagccgtgggcctggccatggaagctttttcagacagccctttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaatgtgaaagttataactattaac

SEQ ID NO: 1064 - DNA, 637 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataactttttagcttcatttgtcattgaaagttctttttattaaattatatttttattgcgtgtttggaatcccatttgagaaattaagaaatcacgtttaaaaattgtgaaagttataactattaacttttgactaaacttgaaaaaatcacatttttgatgtggaaccaaatctgattttgagaaccaagttgattttgatggattttgcaggagaattagccacagaactcaccatcaaaatcatggacacattgagaaggatgaatcctgggttccagtatgtgattaactacttcctctatagttatttttga

SEQ ID NO: 1065 - DNA, 738 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaaggccatggaagcttttcagacagcccttttctaaatagcctggtgggacacatcttgcattcctcaattcttgtgccataccatggatggttagttcatcccggctttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaaatgtgaaagttataactattaacttttgactaaacttgaaaaaatcacatttttgatgtggaaccaaatctgattttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttattaataagttcaagaaaaaagggaatctttatacttcagataaagctgttcttgaacattttttttgtcattatcttagttaaccgag

SEQ ID NO: 1066 - DNA, 699 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgttttaaaaatgtgaaagttataactattaacttttgactaaacttgaaaaaatcacatttttgatgtggaaccaaatctgatttgagaaccaagttgattttgatggattttgcaggagaattagccacagaactcaccattcaaaatcatggacacattgagaaggatgaatcctgggttccagtatgtgattaactacttcctctatagttattttgattcaattaaatttatttatttaataagttctaagaaaaaaagggaatcttttacttcagataaagctg

SEQ ID NO: 1067 - DNA, 742 bp, Artificial
  Glycine max FAD3A mutation created with TALEN pair GmFAD3_T01.1
cactgctttgttatgcctacctcatttcatttggctttagacaacttaaatttgagatctttattatgtttttttgcttatatggtaaagtgattcattcttcacattgaattgaaatggaagctttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaaattgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaagggaatctttatacttcagataaagctgttcttgaacattttttttagtcattatcttagttaaccgag

SEQ ID NO: 1068 - DNA, 729 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgtggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttattaataagttcaagaaaaaggaatcttatacttcagataaagctgttcttgaacattttttttagtcattatcttagttaaccgag

SEQ ID NO: 1069 - DNA, 477 bp, Artificial
  Glycine max FAD3A mutation created with TALEN pair GmFAD3_T01.1
cactgctttgttatgcctacctcatttcatttggctttagtacaacttaaaatttgatgaattctttatttattgtttttttgcttatatggtaaagtgattcattcttcacattgagaggcagggtcggaacaggagagcgcacgagggagcttgccagggggaaacgcctggtatctttatagtcctgtcgggtttcgccagtggccatggaagcttttcagacagcccttttctaaatagcctggtgggacacatcttgcattcctcaattcttgtgccataccatggatggttagttcatcccggctttttgtttgtcattggaagttctttttattgattcaatttttatagcgtgttcggaaaacgcgtttcagaaaataatgaaatacatcttgaatctgaaagttataacttttagcttcattgtcattgaaagttcttttattaattatatttttattgcgtgtttgg

SEQ ID NO: 1070 - DNA, 423 bp, Artificial
  Glycine max FAD3A mutation created with TALEN pair GmFAD3_T01.1
cactgctttgttatgcctacctcatttcatttggctttagacaacttaaatttgagatctttattatgttttgttcttatatggtaaagtgattcattcttcacattgaattgccagcaatattggtctgggggggtcaagccgtgggcctggcacagcaccggcaacagccgctggaccgtctccagcgcctgcttgccaccgtggccatggaagcttttcagacagcccttttctaaatagcctggtgggacacatcttgcattcctcaattcttgtgccataccatggatggttagttcatcccggcttttttcgtttgtcattggaagttcttttattgattcaatttttatagcgtgtcggaaacgcgtttcagaaaagtaatgaaatacatcttgaatctgaaaggttataactttt

SEQ ID NO: 1071 - DNA, 736 bp, Artificial
  Glycine max FAD3A mutation created with TALEN pair GmFAD3_T01.1
cactgctttgttatgcctacctcatttcatttggctttagacaacttaaatttgagatctttattatgtttttttgcttatatggtaaagtgattcattcttcacattgaattgaatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaagggaatctttatacttcagataaagctgttcttgaacattttttttagtcattatcttagttaaccgag

SEQ ID NO: 1072 - DNA, 689 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgagcaggcgctgttgccggtgctgtgccaggcccacggcttgaccccggagcaggtggtggccatcgccagccacgatggcggcaagcaggcgctggagacggtccagcggtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaataatgaaatacatcttgaatctgaaagttataacttttagcttcattgtcattgaaagttcttttattaattatatttttattgcgtgtttggaatcccatttgagaataagaatcacgtttaaatgtgaaagttataactattaacttttgactaaacttgaaaaaaactcacatttttgatgtggaaccaaatctgatttgagaaccaagttgattttgatggattttgcaggagaattagccacagaactcaccatcaaaatcatggacacattgagaagggatg

SEQ ID NO: 1073 - DNA, 481 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattggtatttcacaccgcatatggtgcactctcagtacaatctgctctgatgccgcatagttaagccagccccgacacccgccaacacccgctgacgcgccctgacgggcttgtctgctcccggcttccgcttacagtggccatggaagcttttcagacagcccttttctaaatagcctggtgggacacatcttgcattcctcaattctttgtgccataccatggatggttagttcatcccggcttttttgtttgtcattggaagttcttttattgattcaattttttatagcgtgttcggaaacgcgtttcagaaaaataatgaaatacatcttgaaatctgaaagttataactttttagcttcattgtca

SEQ ID NO: 1074 - DNA, 735 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaattgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttattaataagttcaagaaaaaagggaatctttatacttcagataaagctgttcttgaacatttttttgtcattatcttagttaaccgagaag

SEQ ID NO: 1075 - DNA, 762 bp, Artificial
  Glycine max FAD3A mutation created with TALEN pair GmFAD3_T01.1
cactgctttgttatgcctacctcatttcatttggctttagacaacttaaatttgagatctttattatgtttttttgcttatatggtaaagtgattcattcttcaattcttgtgcgccgggtgttggcttaacgctgccgggtgttggcttaacgcaacgatgtgcgcgtgtgtaaaccagtggccatggaagctttttcagacagccctttttctaaatagcctggtgggacacatcttgcattcctcaattcttgtgccataccatggatggttagttcatcccggcttttttgtttgtcattggaagttcttttattgattcaatttttatagcgtgttcggaaaacgcgtttcagaaaataatgaaaatacatcttgaatctgaaagttataacttttagcttcattgtcattgaaagtttcttttattaattatatttttattgcgtgtttggaatcccatttgagaaataagaaatcacgtttaaaatgtgaaagttataactattaacttttgactaaacttgaaaaaagtcacattttgatgtggaaccaaatctgatttgagaaccaagttgattttgatggattttgcaggagaattagccacagaactcaccatcaaatcatggacacattgagaaggatgaatcctgggtttccagtatgtgattaactacttcctctatagttatttttgattcaattaaatttatttatttaataagttcaagaaaaagggaatctttatacttcagat

SEQ ID NO: 1076 - DNA, 747 bp, Artificial
  Glycine max FAD3A mutation created with TALEN pair GmFAD3_T01.1
cactgctttgttatgcctacctcatttcatttggctttagacaacttaaatttgagatctttattatgtttttttgcttatatggtaaagtgattcattcttcacattgaattgaaaaggccatggaagcttttcagacagcccttttctaaatagcctggtgggacacatcttgcattcctcaattcttgtgccataccatggatggttagttcatcccggctttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaaattgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaaagggaatctttatacttcagataaagctgttcttgaacatttttttttgtcattatcttagttaaccgag

SEQ ID NO: 1077 - DNA, 706 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgattttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttattaatagttcaagaaaaaggaatcttatacttcagataaagctgttcttgaacatttttttt

SEQ ID NO: 1078 - DNA, 651 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaacatgaatacatcttgaatctgaaagttataacttttagcttcattgtcattgaaagtttctttttattaattatattttattgcgtgtttggaatcccatttgagaaataagaaatcacgtttaaaaattgtgaaagttataactattaacttttgactaaacttgaaaaaactcacattttttgatgtggaaccaaatctgatttgagaaccaagttgattttgatggattttgcaggagaattagccacagaactcaccatcaaaatcatggacacattgagaaggattgaatcctgggttccagtatgtgattaactacttcctctatagttatttttgatcaattaaatttattt

SEQ ID NO: 1079 - DNA, 668 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattcagcggctgttgccggtgctgtgccaggcccacggcttgaccccggagcaggtggtggccatcgccagcggccatggaagcttttcagacagcccttttctaaatagcctggtgggacacatcttgcattcctcaattcttgtgccataccatggatggttagttcatcccggctttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaactttgactaaacttgaaaaaagtcacattttgatgtggaaccaaatctgatttgagaaccaagttgatttgatggattttgcaggagaatttagccacagaactcaccatcaaaatcatggacacattgagaaggatgaatcctgggttccagtatgtgattaact

SEQ ID NO: 1080 - DNA, 713 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttattaataagttcaagaaaaaggaatctttatacttcagataaagctgttcttgaacatttttttt

SEQ ID NO: 1081 - DNA, 479 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaacttgccaccgccattgctggcgatggccaccacctgctggggggtcaagccgtgggcctggcacagcaccggcagtggccatggaagcttttcagacagcccttttctaaatagcctggtgggacacatcttgcattcctcaattcttgtgccataccatggatggttagttcatcccggcttttttagtttgtcattggaagttcttttattgattcaattttttgatagcgtgttcggtaaatcgcgtttcagaaaagtaatgaaactacatcttgaatctgaaagttataacttttagcttcattgtcattgaaagtttcttttcattaattatatttttgaattgcgtgtttggaatccc

SEQ ID NO: 1082 - DNA, 697 bp, Artificial
  Glycine max FAD3A mutation created with TALEN pair GmFAD3_T01.1
cactgctttgttatgcctacctcatttcatttggctttagacaacttaaatttgagatctttattatgtttttttgcttatatggtaaagtgattcattcttcacattgaattgaccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaaattgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttattattaataagttcaagaaaaaggaatctttatacttcatgataaagctg

SEQ ID NO: 1083 - DNA, 734 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaaagggagtcacgttatgacccccgccgatgacgcgggacaagccgttttacgtttggaactgacagaaccgcaacgttgaaggagccagtggccatggaagcttttcagacagccctttttctaaatagcctggtgggacacatcttgcattcctcaattcttgtgccataccatggatggttagttcatcccggcttttttgtttgtcattggaagttctttttattgattcaatttttatagcgtgttcggaaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaactttgactaaacttgaaaaaattcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaa

SEQ ID NO: 1084 - DNA, 495 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaccagcgcctgcttgccaccaatattgctggcgatggccaccacctgctccggggtcaagccgtgggcctggcacagcacgtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatcatgaaagttataacttttagcttcattgtcattgaaagttcttttatttaattatatttttattgctgtgtttggaatcccatttgagaaataagaaatca

SEQ ID NO: 1085 - DNA, 814 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaacagcaccggcaacagccgctggaccgtctccagcgcctgcttgccaccgccattgctggcgatggccaccacctgctggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaaacgcgtttcagaaaaataatgaaaatacatcttgaatctgaaagttataacttttagcttcattgtcattgaaagttcttttattaattatatttttattgcgtgtttggaatcccatttgagaaataagaaatcacgtttaaaaatgtgaaagttataactattaacttttgactaaacttgaaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaaagaaaaaaaggaatctttatacttcagaataaagctgttcttgaacattttttttgtcattattctag

SEQ ID NO: 1086 - DNA, 472 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaattggaagctttttcagacagccctttttctaaaattagcctggtggggacacatcttgcattcctcaattcttgtgccataccatggatggttagttcatccccggcttttttggtttgtcattggaagttcttttattgattcaattttatagcgtgttcggaaacgcgtttcagaaaaagtaatgaaatacatcttgaatctgaaagttataacttttagcttcattgtcattgaaagttctttttattaaattatattttattgcgtgtttggaatcccatttgagaaataagaaatcacgtttaaaaattgtgaaagttataactattaacttttgactaaacttgaaaaaac

SEQ ID NO: 1087 - DNA, 741 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaaattgtgaaagttataactattaacttttgactaaacttgaaaaaactcacatttttgatgtggaaccaaaatctgattttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaagggaatctttatacttcagataaagctgttcttgaacattttttttagtcattatcttagttaaccgag

SEQ ID NO: 1088 - DNA, 746 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagtttctttttattaattatatttttatttgcgtgtttggaatcccatttgagaataagaaatcacgtttaaaaattgtgaaagttataactattaacttttgactaaacttgaaaaaactcacattttttgatgtggaaccaaatctgattttgagaaccaagttgattttgatggattttgcaggagaattagccacagaactcaccatcaaaatcatggacacattgagaaggattgaatcctgggttccagtatgtgattaactacttcctctatagttatttttgattcaattaaatttatttattaatagttcaagaaaaaggaatcttatacttcagataaagctgattcttgaacattttttttagtcaattatcttagttaaccgag

SEQ ID NO: 1089 - DNA, 736 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataactttttagcttcattgtcattgaaagttctttttattaattatatttttattgcgtgtttggaatcccatttgagaaataagaaatcacgtttaaaaatgtgaaagttataactattaacttttgactaaacttgaaaaaatcacatttttgatgtggaaccaaatctgattttgagaaccaagttgattttgatggattttgcaggagaattagccacagaactcaccatcaaaatcatggacacattgagaaggatgaatcctgggttccagtatgtgattaactacttcctctatagttattttgattcaattaaatttattattaataagttcaagaaaaaaggaatctttatacttcagataaagctgttcttgaacattttttttgtcattatcttagttaaccgag

SEQ ID NO: 1090 - DNA, 729 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatattttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaaggaatctttatacttcagataaagctgattcttgaacattttttttgtcattatcttagttaaccgag

SEQ ID NO: 1091 - DNA, 581 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaaatgtgaaagttataactattaacttttgactaaaacttgaaaaaatcacattttgatgtggaaccaaatctgatttgagaaccaagttgaattttgatggattttgcaggagaattagccacaagaactcaccatcaaaaatcatggacacattgagaaggatgaatcct

SEQ ID NO: 1092 - DNA, 703 bp, Artificial
  Glycine max FAD3A mutation created with TALEN pair GmFAD3_T01.1
cactgctttgttatgcctacctcatttcatttggctttagacaacttaaatttgagatctttattatgttttttgccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaaatgtgaaagttataactattaacttttgactaaacttgaaaaaagtcacatttttgatgtggaaccaaatctgatttgagaaccaagttgattttgatggattttgcaggagaattagccacatgaactcaccatcaaaatcatggacacattgagaaggatgaatcctgggttccagtatgtgattaactacttcctctatagttatttttgattcaattaaatttatttatttaataagttcaagaaaaaaggatctttatacttcagataaagctgttcttgaacatttttttttcgtcattatcttagttaaccgagaag

SEQ ID NO: 1093 - DNA, 738 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaatgtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttaattaattatattttattgcgtgtttggaatcccatttgagaaataagaaatcacgtttaaaaatgtgaaagttataactattaacttttgactaaacttgaaaaaatcacatttttgatgtggaaccaaatctgattttgagaaccaagttgattttgatggattttgcaggagaattagccacagaactcaccatcaaaatcatggacacattgagaaggatgaatcctgggttccagtatgtgattaactacttcctctatagttattttgattcaattaaaatttatttatttaataagttcaagaaaaaaaggaatctttatacttcagataaagctgttcttgaacatttttttgtcattatcttagttaaccgag

SEQ ID NO: 1094 - DNA, 453 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaacgtgggcctggcacagcaccggcaacagccgctggaccgtctccagcgcctgcttgccaccgccattgctggcgatggccaccacctgctggggggctcaagccgtgggatactgttcgttctagtgtagccgtagttaggccaccacttcaagaactctgtagcaccgcctacatacctcgctctgctaatcctgttaccagtggccatggaagcttttcagacagcccttttcctaaaatagcctggtgggacacatctgcattcctcaattcttgtgccataccatggatggttagttcatcccggcttttttgtttgtcatggaagtctttatt

SEQ ID NO: 1095 - DNA, 511 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgagccatggaagctttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatattttattgcgtgtttggaatcccatttgagaaataagaaatcacgtttaaaaattgtgaaagttataatctattaacttttagactaaacttgaaaaaatcacatttttgaatgtggaccaaattctgatttgagaaccaagtt

SEQ ID NO: 1096 - DNA, 736 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgattttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttattaataagttcaagaaaaaaggaatctttatacttcagataaagctgttcttgaacatttttttgtcattatcttagttaaccgag

SEQ ID NO: 1097 - DNA, 741 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgacatggaagcttttcagacagccctttttctaaatagcctggtgggacacatcttgcattcctcaattcttgtgccataccatggatggttagttcatcccggcttttttgtttgtcattggaagttcttttattgattcaattttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaaattgtgaaagttataactattaacttttgactaaacttgaaaaaactcacattttttgatgtggaaccaaatctgatttgagaaccaagttgattttgatggatttttgcaggagaattagccacagaactcaccatcaaaatcatggacacattgagaaggatgaatcctgggttccagtatgtgattaactacttcctctatagttattttgattcaattaatttatttatttaataagttcaagaaaaaagggaatctttatacttcagataaagctgttcttgaacattttttttagtcattatcttagtttaaccgag

SEQ ID NO: 1098 - DNA, 843 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaacaagattgcaaaacgtggcggcgtgaccgcagtggaggcagtgcatgcatggcgcaatgcactgacgggtgccccgctcaacttgaccccccagcaggtgatggccatggaagcttttcagacagcccttttctaaatagcctggtgggacacatcttgcattcctcaattcttgtgccataccatggatggttagttcatcccggctttttgtttgtcattggaagttcttttattgattcaatttttatagcgtgttcggaaacgcgtttcagaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaatcacatttttgatgtggaaccaaattctgatttgagaaccaagttgattttgatggattttgcaggagaattagccacagaactcaccatcaaaaatcatggacacattgagaagggatgaatcctgggttccagtatgtgattaactacttcctctatagttattttttggattcaatttaattttatttatttaataagttcaagaaaaaaggaatctttatacttcagataaaatgctgttctttgaaacattttttttcgtcattatcttagtt

SEQ ID NO: 1099 - DNA, 558 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaatggccatggaagctttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataactttttagcttcattgtcattgaaagttcttttattaattatatttttattgcgtgtttggaatcccatttgagaaataagaaatcacgtttaaaaatgtgaaagttataactattaacttttgactaaacttgaaaaaactcacatttttgatgtggaaccaaatctgattttgagaaccaagttgattttgatggattttgcaggagaattagccacagaactcacca

SEQ ID NO: 1100 - DNA, 716 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgtggccatggaagcttttcagacagcccttttctaaatagcctggtgggacacatcttgcattcctcaattcttgtgccataccatggatggttagttcatcccggctttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgattttgagaaccaagttgattttgatggattttgcagagaattagccacagaactcaccatcaaaatcatggacacattgagaaggatgaatcctgggttccagtatgtgattaactacttcctctatagttattttgattcaattaaatttatttatttaataagttcaagaaaaaaggaatctttatacttcagataaagctgttcttgaacatttttttt

SEQ ID NO: 1101 - DNA, 631 bp, Artificial
  Glycine max FAD3A mutation created with TALEN pair GmFAD3_T01.1
cactgctttgttatgcctaccctcatttgcatttggcttagacaacttaaatttgagatctttattatgtttttttgcttatatggtaaagtgattcattcttcacattgaatcatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatattttattgcgtgtttggaatcccatttgagaaataagaaatcacgtttaaaatgtgaaagttataactattaacttttgactaaacttgaaaaaatcacatttttgatgtggaaccaaatctgattttgagaaccaagttgattttgatggattttgcaggagaattagccacagaactcaccatcaaaatcatggacacattgagaaggatgaatcctgggttccagtatgtgattaactacttcctctatagttatttttgattc

SEQ ID NO: 1102 - DNA, 801 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgagactctaattggataccgaggcgaatttatggaacgtcagtggagcattttttgacaagaaatatttgctaccatgattacgaattcccgatctagtaacatagatgacaccgcgcgcgataatttatcctagtttgcgcgctatattttgttttctatcgcgtattaaatgtataattgcgggactctaatcataaaaaacccatctcataaaatggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaatagaaatcacgtttaaaatgtgaaagttataactattaacttttgactaaacttgaaaaatcaacatttttgatgtaggaaccaaatctgatttgagaaccaagttgattttgatggatttttgcaggatgaattagccacagaactcaccatcaaaatcatggacacattgagaaggatgaat

SEQ ID NO: 1103 - DNA, 599 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaatatggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttatacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgattttgagaaccaagttgattttgatggattttgcaggagaattagccacagaactcaccatcaaaatcatggacacattgagaaggatgaatcctgggttccagtatg

SEQ ID NO: 1104 - DNA, 741 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaaccatggaagcttttcagacagcccttttctaaatagcctggtgggacacatcttgcattcctcaattcttgtgccataccatggatggttagttcatcccggctttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaaatgtgaaagttataactattaactttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaaaggaatctttatacttcagataaagctgttcttgaacattttttttgtcattatcttagttaaccgag

SEQ ID NO: 1105 - DNA, 741 bp, Artificial
  Glycine max FAD3A mutation created with TALEN pair GmFAD3_T01.1
cactgctttgttatgcctacctcatttcatttggctttagacaacttaaatttgagatctttattatgtttttttgcttatatggtaaagtgattcattcttcacattgaattgaccatggaagcttttcagacagcccttttctaaatagcctggtgggacacatcttgcattccccaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaactttttgactaaacttgaaaaaatcacatttttgatgtggaaccaaatctgatttgagaaccaagttgattttgatggattttgcaggagaattagccacagaactcaccatcaaaaatcatggacacattgagaaggatgaatcctgggttccagtatgtgattaactacttcctctatagttatttttgattcaattaaatttatttatttaataagttcaagaaaaaagggaatctttatacttcagataaagctgttcttgaacattttttttagtcattatcttagttaaccgag

SEQ ID NO: 1106 - DNA, 821 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattggttgccggtgctgtgccaggcccacggcttgaccccggagcaggtggtggccatcgccagcaatattggtggcaagcagtggccatggaagctttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggtatgaatcctgggttccagtatgtgattaactacttcctctatagttatttttgattcaattaaatttatttatttaataagttcaagaaaaaagggaatctttatacttcagataaagctgttcttgaacattttttttgtcattattctagtttaaccga

SEQ ID NO: 1107 - DNA, 656 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaatttggccatggaagcttttcagacagccctttttctaaaatagcctggtgggacacatcttgcattcctcaattcttgtgccataccatggatggttagttcatccccggcttttttgtttgtcattggaagttcttttattgattcaattttatagcgtgttcggaaacgcgtttcagaaaaataatgaaatacatcttgaatctgaaagttataactttttagcttcattgtcattgaaaagttctttttattaattatatttttattgcgtgtttggaatcccatttgagaaataagaaatcacgtttaaaaattgtgaaagttataactattaacttttgactaaacttgaaaaaactcacatttttgatgtggaaccaaatctgattttgagaaccaagttgattttgaatggattttcgcaggaaaattagccacagaactcaccatcaaaatcatggacacattgagaaggatgaatcctgggttccagtatgtgattaactacttcctctatagttatttttgattcaattaaattta

SEQ ID NO: 1108 - DNA, 605 bp, Artificial
  Glycine max FAD3A mutation created with TALEN pair GmFAD3_T01.1
  misc_feature (395): n is a or c or t or g
cactgctttgttatgcctacctcatttcatttggctttagacaacttaaatttgagatctttattatgttttttgcttatatggtaaagtgattcattcttcacattgaattgccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcttgaaaagttctttttattaattatatttttatttgcggtttggaatcccatttgngaaataagaaatcatcgtttaaaattgtgaaagttataactattaacttttgactaaacttgaaaaaactcacatttttgatgtggaaccaaatctgatttgagaaccaagttgatttgatggatttgcaggagaattagccacagaactcaccatcaaaatcatggacacattgagaggatgaatcctgggttccagtatgtgattaac

SEQ ID NO: 1109 - DNA, 494 bp, Artificial
  Glycine max FAD3A mutation created with TALEN pair GmFAD3_T01.1
  misc_feature (388): n is a or c or t or g
cactgctttgttatgcctacctcatttcatttggctttagacaacttaaatttgagatctttattatgttttttgcttatatggtaaagtgattcattcttcacattgaattgaaaccctgagtcattaatatgtgacgcaccaagcccaccaaagcagtggccatggaagcttttcagacagcccttttctaaatagcctggtgggacacatcttgcattcctcaattcttgtgccataccatggatggttagttcatcccggctttttttgtttgtcattggaagttcttttattgattcaatttttatagcgtgttcggaaacgcgtttcagaaaatatgaaatacatcttgaatctgaaaagttataacttttagcttcattgncattgaaagttctttttattaattatatttttattgcgtgtttggaatcccatttgagaaatagaaatcacgtttaaaatgtgaaagttataactattaacttttg

SEQ ID NO: 1110 - DNA, 738 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataactttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttattaataagttcaagaaaaaagggaatctttatacttcagataaagctgattcttgaacattttttttgtcattatcttagttaaccgag

SEQ ID NO: 1111 - DNA, 492 bp, Artificial
  Glycine max FAD3A mutation created with TALEN pair GmFAD3_T01.1
cactgctttgttatgcctacctcatttcatttggctttagacaacttaaatttgagatctttattatgtttttttgcttatatggtaaagtgattcattcttcacattgaattggccatggaagcttttcagacagcccttttctaaatagcctggtgggacacatcttgcattcctcaattcttgtgccataccatggatggttagttcatcccggctttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctga

SEQ ID NO: 1112 - DNA, 698 bp, Artificial
  Glycine max FAD3A mutation created with TALEN pair GmFAD3_T01.1
cactgctttgttatgcctacctcatttcatttggctttagacaacttaaatttgagatctttattatgtttttttgcttatatggtaaagtgattcattcttcacattgaattgagccatggaagcttttcagacagcccttttctaaatagcctggtgggacacatcttgcattcctcaattcttgtgccataccatggatggttagttcatcccggctttttttgtttgtcattggaagttcttttattgattcaatttttatagcgtgttcggaaacgcgtttcagaaaataatgaaatacatcttgaatctgaaagttataacttttagcttcatttgtcattgaaaagttctttttattaaattatatttttattgcgtgtttggaatcccatttgagaaataagaaaatcacgtttaaaaatgtgaaagttataactattaacttttgactaaacttgaaaaaatcacatttttgatgtggaacccaaaatctgattttgagaaccaagttgatttgatggattttgcaggagaattagccacagaactcaccatcaaaaatcatggacacattgagaaggatgaatcctgggttccagtatgtgattaactacttcctctatagttattttgattcaattaaatttatttatttaataagttcaagaaaaaaaggaatctttatacttcag

SEQ ID NO: 1113 - DNA, 520 bp, Artificial
  Glycine max FAD3A mutation created with TALEN pair GmFAD3_T01.1
cactgctttgttatgcctacctcaattcaatgtgaagaatgaatcactttaccatataagcaaaaacataataaagatctcaaatttaagttcagtggccatggaagcttttcagacagcccttttctaaatagcctggtgggacacatcttgcattcctcaatcttgtgccataccatggatggttagttcatcccggcttttttgtttgtcattggaagttcttttattgattcaatttttatagcgtgttcggaaactgcgtttcagaaaataatgaaatacatcttgaatctgaaagttataactttagcttcattgtcattgaaaatgttcttttattaattatatttttattgcgtgtttggaatcccatttgagaaataagaaatcacgtttaaaatgtgaaagttataactatttaaacttttgactaaaacttgaaaaaatcacattttgatgtggaaccaaatctgatttgagaaccaagttgattttgatggatttttgcaggagaatt

SEQ ID NO: 1114 - DNA, 647 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaacagacagtggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaatt

SEQ ID NO: 1115 - DNA, 607 bp, Artificial
  Glycine max FAD3A mutation created with TALEN pair GmFAD3_T01.1
cactgctttgttatgcctacctcatttcatttggctttagacaacttaaatttgagatctttattatgtttttgcttatatggtaaagtgattcattcttcacattgaattgaatgctggggggtcaagccgtgggcctggcacagcaccggcaacagccgctggaccgtctccagcggccatggaagcttttcagacagcccttttctaaatagcctggtgggacacatcttgcattcctcaattcttgtgccataccatggatggttagttcatcccggctttttgttgtcattggaagttcttttattgatcaattttatagcgtgttcggaaacgcgtttcagaaaataatgaaatacatcttgaatctgaaagttataacttttagcttcattgtcattgaaagttctttattaattatatttttattgcgtgtttggaatcccatttgagaaataagaaattcacgtttaaaatgtgaaagttattaactattaactttgactaacttgaaaaagtcacattttgatgtggaaccaaatcgatttgagaaccagttgatttgatggatttcgcaggagaattagccacagaactcaccatc

SEQ ID NO: 1116 - DNA, 705 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacatggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatattttattgcgtgtttggaatcccatttgagaaataagaaatcacgtttaaaatgtgaaagttataactattaacttttgactaaacttgaaaaaatcacatttttgatgtggaaccaaatctgattttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatcttatacttcagataaagctgttcttgaacattttttt

SEQ ID NO: 1117 - DNA, 709 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaacaggcgctggagacggtccagcggctgttgccggtgctgtgccaggcccacggcttgaccccggagcaggtggccatggaagcttttcagacagcccttttctaaatagcctggtgggacacatcttgcattcctcaattcttgtgccataccatggatggttagttcatcccggcttttttgtttgtcattggaagttctttttattgattcaatttttatagcgtgttcggaaacgcgtttcagaaaaataatgaaatacatcttgaatctgaaagttataacttttagcttcattgtcattgaaagttcttttattaattatatttttattgcgtgtttggaatcccatttgagaataagaaatcacgtttaaatgtgaaagttataactattaacttttgactaaacttgaaaaaattcacatttttgatgtggaaccaaatctgatttgagaaccaaagttgattttgatggattttgcaggagaatttagccacagaactcaccatcaaaatcatggacacattgagaaggatgaatcctgggttccagtatgtgattaactacttcctctatagttatttttgattc

SEQ ID NO: 1118 - DNA, 679 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaacttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaatggaatctttatacttcagataaagctgttcttgaacattttttttttcgtcattatctag

SEQ ID NO: 1119 - DNA, 739 bp, Artificial
  Glycine max FAD3A mutation created with TALEN pair GmFAD3_T01.1
cactgctttgttatgcctacctcatttcatttggctttagacaacttaaatttgagatctttattatgtttttttgcttatatggtaaagtgattcattcttcacattgaattgaaccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaaattgtgaaagttataactattaactttttgactaaacttgaaaaaactcacattttttgatgtggaaccaaaatctgattttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaagggaatctttatacttcagataaagctgttcttgaacattttttttagtcattatcttag

SEQ ID NO: 1120 - DNA, 472 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgttggcgatggccaccacctgctccggggtcaagccgtgggcctggcacagcaccggcaacagccgctggaccgtctccagcggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatccca

SEQ ID NO: 1121 - DNA, 523 bp, Artificial
  Glycine max FAD3A mutation created with TALEN pair GmFAD3_T01.1
cactgctttgttatgcctacctcatttcatttggctttagacaacttaaatttgagatctttattatgtttttttgcttatatggtaaagtgattcattcttcacattgaattgaaccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgttcagaaaataatgaaatacatcttgaatctgaaagttataactttttagcttcattgtcattgaaagttctttttattaattatatttttattgcgtgtttggaatcccatttgagaaataagaaaatcacgtttaaaaatgtgaaagttataactattaactttttgactaaacttgaaaaaatcacatttttgatgtggaaccaaatctgatttgagaaccaagttgattttgatgga

SEQ ID NO: 1122 - DNA, 549 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcatgtcttgaaagttcttttattaattatatttttatttgcggtttggaatcccatttgagaaataagaaatcacgtttaaaatgtgaaagttataactattaacttttgactaaacttgaaaaaactcacattttgatgtggaaccaaatctgtttgagaaccaagttgaattttgatggattttgcaggagaattagccacagaactcaccatc

SEQ ID NO: 1123 - DNA, 566 bp, Artificial
  Glycine max FAD3A mutation created with TALEN pair GmFAD3_T01.1
cactgctttgttatgcctacctcatttcatttggctttagacaacttaaatttgagatctttattatgtttttttgcttatatggtaaagtgattcattcttcacattcattcattccatggaagcttttcagacagccctttttctaaatagcctggtgggacacatcttgcattcctcaattcttgtgccataccatggatggttagttcatcccggctttttttgtttgtcattggaagttcttttattgattcaatttttatagcgtgttcggaaacgcgtttcagaaaataatgaaatacatcttgaatctgaaagttataactttttagcttcattgtcattgaaaagttctttttatttaaattatatttttattgcgtgtttggaatcccatttgagaaattaagaaatcacgtttaaaaattgtgaaagttataactattaactttttgactaaacttgaaaaaactcacatttttgatgtggaaccaaatctgattttgagaaccaagttgattttgatggattttgcaggagaattagccacagaactcaccatc

SEQ ID NO: 1124 - DNA, 717 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaccatggaagcttttcagacagcccttttctacatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgattttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaagggaatctttatacttcagataaagctgttcttgaacatttttttt

SEQ ID NO: 1125 - DNA, 585 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaacttgcattcctcaattcttgtgccataccatggatggttagttcatcccggcttttttgtttgtcattggaagttcttttattgattcaatttttatagcgtgttcggaaacgcgttttcagaaaataatgaaatacatcttgaatctgaaagttataactttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccagttgattttgatggattttgcaggagaatttagccacagaactcaccatcaaaatcatggacacattgagaaggatgaatcctgggttccagtatgtgattaactacttcctctatagttatttttgattc

SEQ ID NO: 1126 - DNA, 454 bp, Artificial
  Glycine max FAD3A mutation created with TALEN pair GmFAD3_T01.1
  misc_feature (281): n is a or c or t or g
cactgctttgttatgcctacctcatttcatttggctttagacaacttaaatttgagatctttattatgttttttgcttatatggtaaagtgattcattcttcacattgaattgattcaattcttgtgccataccatggatggttagttcatcccggctttttttgtttgtcattggaagttctttttattgattcaatttttatagcgtgttcggaaacgcgtttcagaaaataatgaaatacatcttgaatctgaaagttataacttttagcttcattgncattgaaagttcttttattaaattatattttttattgcgtgtttggaatcccattttgagaaaataagaaatcacgtttaaaatgtgaaaagttataactattaacttttgactaaacttgaaaaaatcacatttttgatgtggaaccaaatctgatttgagaaccaagttga

SEQ ID NO: 1127 - DNA, 623 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaaggccatgggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatattttattgcgtgtttggaatcccatttgagaataagaaatcacgtttaaaatgtgaaagttataactattaacttttgactaaacttgaaaaaatcacatttttgatgtggaaccaaatctgattttgagaaccaagtttgattttgatggattttgcaggagaattagccacagaactcaccatcaaaatcatggacacattgagaaggatgaatcctgggttccagtatgtgattaactacttcctctatagtta

SEQ ID NO: 1128 - DNA, 626 bp, Artificial
  Glycine max FAD3A mutation created with TALEN pair GmFAD3_T01.1
cactgctttgttatgcctacctcatttcatttggctttagacaacttaaatttgagatctttattatgtttttttgcttatatggtaaagtgattcattcttcacattgaattgaatggccatggaagcttttcagacagaccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaaagttataacttttagcttcattgtcattgaaagttcttttattaattatatttttattgcgtgttttggaatcccatttgagaaataagaaatcacgtttaaaaatgtgaaagttataactattaacttttgactaaacttgaaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctcta

SEQ ID NO: 1129 - DNA, 731 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgattttgagaaccaagttgaattttgatggattttgcatggagaattagccacagaactcaccattcaaaatcatggacacattgagaaggatgaatcctgggttccagtatgtgattaactacttcctctatagttattttgattcaattaaatttatttatttaataagttcaagaaaaaaggaatctttatacttcagataaagctgttcttgaacattttttttgtcattatcttagttaaccgagaag

SEQ ID NO: 1130 - DNA, 723 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaccatggaagcttttcagacagcccttttctaaatagcctggtgggacacatcttgcattcctcaattcttgtgccataccatggatggttagttcatcccggctttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaaattgtgaaagttataactattaacttttgactaaacttgaaaaaatcacatttttgatgtggaaccaaatctgatttgagaaccaagttgattttgatggattttgcaggagaattagccacagaactcaccatcaaaaatcatggacacattgagaaggatgaatcctgggttccagtatgtgattaactacttcctctatagtttatttttgattcaattaaaatttatttatttaataagttcaagaaaaaaagggaatctttatacttcagataaagctgttcttgaacatttttttt

SEQ ID NO: 1131 - DNA, 734 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaacatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttattaataagttcaagaaaaaaggaatcttatacttcagataaagctgttcttgaacatttttttagtcattatcttagttaaccgag

SEQ ID NO: 1132 - DNA, 839 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaacaggagagcgcacgagggagcttccagggggaaacgcctggtatctttatagtcctgtcgggtttcgccacctctgacttgagcgtcgatttttgtgatgctcgtcaggggggcggagcctatggaaagcgaagaggcccgcaccgatcgcccttcccaacagttgcgcagcctgaatggcgaatggcgcctgatgcggtattttctccttacgcatctgtgcggtatttcacaccgcagtggccatggaagcttttcagacagccctttttctaaatagcctggtgggacacatcttgcattcctcaattcttgtgccataccatgggatggttagttcatcccggcttttttgttgtcattggaagttcttttatgattcaattttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaatcacatttttgatgtggaaccaaatctgatttgagaaccaagttgatttttagatggatttttgcaggagaatttagccacagaactcatccatcaaattcatggacacattgagaaggtatgaatcctgggttcc

SEQ ID NO: 1133 - DNA, 736 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttataattatattttattgcgtgtttggaaatcccatttgagaaataagaaatcacgtttaaaattgtgaaagttataactattaacttttgactaaacttgaaaaaactcacattttttgatgtggaaccaaaatctgattttgagaaccaagttgattttgatggattttgcaggagaattagccacagaactcaccatcaaaatcatggacacattgagaaggatgaatcctgggttccagtatgtgattaactacttcctctatagtatttttgattcaattaaatttatttatttaataagttcaagaaaaagggaatctttatacttcagataaagctgttcttgaacatttttttagtcattatcttagttaaccgag

SEQ ID NO: 1134 - DNA, 493 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctga

SEQ ID NO: 1135 - DNA, 618 bp, Artificial
  Glycine max FAD3A mutation created with TALEN pair GmFAD3_T01.1
cactgctttgttatgcctacctcatttcatttggctttagacaacttaaatttgagatctttattatgtttttttgcttatatggtaaagtgattcattcttcacattgaattgaatggccatggaagcttttcagacagaccttttctaaatagcctggtgggacacatcttgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaaagttataacttttagcttcattgtcattgaaagttcttttattaaattatatttttattgcgtgtttggaatcccatttgagaaataagaaatcacgtttaaaaatgtgaaagttataactattaactttttgactaaaacttgaaaaaaatcacatttttgatgtggaaccaaaatctgatttgagaaccaagttgattttgatggattttgcaggagaattagccacagaaactcaccatcaaaaatcatggacacattgagaaggatgaatcctgggttccagtatgtgatt

SEQ ID NO: 1136 - DNA, 725 bp, Artificial
  Glycine max FAD3A mutation created with TALEN pair GmFAD3_T01.1
cactgctttgttatgcctacctcatttcatttggctttagacaacttaaatttgagatcttttattatgttttttgcttatatggtaaagtgattcattcttcacattgaattgaacaggagagcgcacgagggagcttccagggggaaacgcctggtatctttatagtcctgtcgggtttcgccacctctgacttgagcgtcgatttttgtgatgctcgtcaggggggcggagcctatggaaagcgaagaggcccgcaccgatcgcccttcccaacagttgcgcagcctgaatggcgaatggcgcctgatgcggtattttctccttacgcatctgtgcggtatttcacaccgcagtggccatggaagcttttcagacagccctttttctaaatagcctggtgggacacatcttgcattcctcaattcttgtgccataccatggatggttagttcatcccggcttttttgttgtcattggaagttcttttatgattcaattttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataacatattaacttttgactaaacttgaaaaatcacatttttgatgtggaacc

SEQ ID NO: 1137 - DNA, 716 bp, Artificial
  Glycine max FAD3A mutation created with TALEN pair GmFAD3_T01.1
cactgctttgttatgcctacctcatttcatttggctttagacaacttaaatttgagatctttattatgttttttgcttatatggtaaagtgattcattcttcacattgaattgaaggccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgattttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatcttatacttcagataaagctgttcttgaacatttttttt

SEQ ID NO: 1138 - DNA, 725 bp, Artificial
  Glycine max FAD3A mutation created with TALEN pair GmFAD3_T01.1
  misc_feature (682): n is a or c or t or g
cactgctttgttatgcctacctcatttcatttggctttagacaacttaaatttgagatctttattatgttttttgcttatatggtaaagtgattcattcttcacattgaattgccatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaaattgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttggattcaattaaatttatttatttaataagttcagaaaaaagggaatctttntactcagataaagctgtcttgaacattttttttagtcattatc

SEQ ID NO: 1139 - DNA, 648 bp, Artificial
  Glycine max FAD3A mutation created with TALEN pair GmFAD3_T01.1
cactgctttgttatgcctacctcatttcatttggctttagacaacttaaatttgagatctttattatgtttttttgcttatatggtaaagtgattcattcttcacattgaattcatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcatttgtcattgaaaagttctttttattaattatatttttattgcgtgtttggaatcccatttgagaaataagaaatcacgtttaaaattgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttattt

SEQ ID NO: 1140 - DNA, 619 bp, Artificial
  Glycine max FAD3A mutation created with TALEN pair GmFAD3_T01.1
cactgctttgttagcctacctcatttcatttggctttagacaacttaaatttgagatctttattatgtttttttgcttatatggtaaagtgattcattcttcacattgaattgaacatggaagcttttcagacagcccttttctaaatagcctggtgggacacatcttgcattcctcaattcttgtgccataccatggatggttagttcatcccggcttttttgtttgtcattggaagttcttttattgattcaatttttatagcgtgttcggaaacgcgtttcagaaaataatgaaattacatcttgaatctgaaagttataacttttagcttcattgtcattgaaaagttctttttattaattatatttttattgcgtgtttggaatcccatttgagaaataagaaattcacgtttaaaaattgtgaaagttataactattaacttttgactaaacttgaaaaaactcacattttttgatgtggaaccaaaatctgattttgagaaccaagttgattttgatggattttgccaggagaattagccacagaactcaccatcaaaatcatggacacattgagaaggatgaatcctgggttccagtatgtgattaactac

SEQ ID NO: 1141 - DNA, 790 bp, Artificial
  Glycine max FAD3B mutation created with TALEN pair GmFAD3_T01.1
  misc_feature (297): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaatgaagctttgccaggaatattgccctttgccttgatagactggctgggatcgacatcttgcattgccttccattcattgttgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggaatctttatgcttcctgaggctgttcttgaacatggctcttttttatgtgtcattatcttagttaa

SEQ ID NO: 1142 - DNA, 689 bp, Artificial
  Glycine max FAD3B mutation created with TALEN pair GmFAD3_T01.1
ctcacacattgttctgttatgtcatttcttcttcatttggctttagacaacttaaatttcagatagccctttgctgaatagcctggtgggacacatcttgcattcctcaattcttgtgccataccatggatggttagttcatactggcttttttgtttgttcatttgtcattgaaaaaatcttttgttgattcaattatttttatagtgtgtttggaagcccgtttgagaaaataagaaatcgcatctggaatgtgaaagttataactatttagcttcatttgtcgttgcaagttcttttattggttaaatttttatagcgtgctaggaaaccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaaaggggaatctttatgcttcctgaggctgttcttgaacatggctcttttttatgtgtcattatcttagtt

SEQ ID NO: 1143 - DNA, 688 bp, Artificial
  Glycine max FAD3B mutation created with TALEN pair GmFAD3_T01.1
ctcacacattgttctgttatgtcatttcttcttcatttggctttagacaacttaaatttcagatagccctttgctgaatagcctggtgggacacatcttgcattcctcaattcttgtgccataccatggatggttagttcatactggcttttttgtttgttcatttgtcattgaaaaaatcttttgttgattcaattatttttatagtgtgtttggaagcccgtttgagaaaataagaaatcgcatctggaatgtgaaagttataactatttagcttcatttgtcgttgcaagttcttttattggttaaatttttatagcgtgctaggaaaccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaaagggaatctttatgcttcctgaggctgttcttgaacatggctcttttttatgtgtcattatcttagtt

SEQ ID NO: 1144 - DNA, 603 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttttgttgattcaattattttatagtgtgtttggaagcccgtttgagaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtggtccaagaaaaaaagggatctttatgcttcctgaggctgttcttgaacatggctcttttta

SEQ ID NO: 1145 - DNA, 788 bp, Artificial
  Glycine max FAD3B mutation created with TALEN pair GmFAD3_T01.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattggcgatggccaccacctgctggggggtcaagccgtgggcctggcacagcaccggcaacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaagggaatctttatgcttcctgaggctgttcttgaacatggctcttttttatgtgtcattatcttagttaa

SEQ ID NO: 1146 - DNA, 688 bp, Artificial
  Glycine max FAD3B mutation created with TALEN pair GmFAD3_T01.1
ctcacacattgttctgttatgtcatttcttcttcatttggctttagacaacttaaatttcagatagccctttgctgaatagcctggtgggacacatcttgcattcctcaattcttgtgccataccatggatggttagttcatactggctttttgtttgttcatttgtcattgaaaaaatctttgttgattcaattatttttatagtgtgtttggaagcccgtttgagaaaataagaaatcgcatctggaatgtgaaagttataactatttagcttcatttgtcgttgcaagttcttttattggttaaatttttatagcgtgctaggaaacccattcgagaaaataagaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaaccatggacacattgagaaggatgagtcatgggttccagtatgtgattaattgcttctcctatagttgttcttgattcaattacattttatttatttggtaggtccaagaaaaaaggggaatctttatgcttcctgaggctgttcttgaacatggctcttttttatgtgtcattatcttagtt

SEQ ID NO: 1147 - DNA, 691 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgatccatggaagcttttcagatagccctttgctgaatagcctggtgggacacatcttgcattcctcaattcttgtgccataccatggatggttagttcatactggcttttttgtttgttcatttgtcattgaaaaaaagtcttttgttgattcaattatttttatagtgtgtttggaagcccgtttgagaaaaattaagaaatcgcatctggaatgtgaaagttataactatttagcttcatttgtcgttgcaagttcttttattggttaaatttttatagcgtgctaggaaacccattcaagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggta

SEQ ID NO: 1148 - DNA, 785 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaattgaacagtatatggaagcttttcagatagccctttgctgaatagcctggtgggacacatcttgcattcctcaattcttgtgccataccatggatggttagttcatactggcttttttgtttgttcatttgtcattgaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggaatgagtcatgggttccagtatgtgattaattgcttctcctatagttgttcttgattcaattacattttatttatttggtaggtccaagaaaaagggaatctttatgcttcctgaggctgttcttgaacatggctcttttttatgtgtcattatcttagttaa

SEQ ID NO: 1149 - DNA, 698 bp, Artificial
  Glycine max FAD3B mutation created with TALEN pair GmFAD3_T01.1
ctcacacattgttctgttatgtcatttcttcttcattgattgaattgaaccatggaagcttttcagatagccctttgctgaatagcctggtgggacacatcttgcattcctcaattcttgtgccataccatggatggttagttcatactggcttttttgtttgttcatttgtcattgaaaaaaatcttttgttgattcaattatttttatagtgtgtttggaagcccgtttgagaaaataagaaatcgcatctggaatgtgaaagttataactatttagcttcatttgtcgttgcaagttcttttattggttaaatttttatagcgtgctaggaaaacccattcgagaaaataagaaatcacatctggaatgtgaaagttataactgttagcttctgagtaaacgtggaaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaaaaggggaatctttatgcttcctgaggctgttcttgaacatggctcttttttatgtgtcattatcttagtt

SEQ ID NO: 1150 - DNA, 758 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgaatggaagcttttcagatagccctttgctgaatagcctggtgggacacatcttgcattcctcaattcttgtgccataccatggatggttagttcatactggcttttttgtttgttcatttgtcattgaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtcccaagaaaaagggaatctttatgcattcctgaggctgttcttgaacatggctcttttttatgtgtca

SEQ ID NO: 1151 - DNA, 694 bp, Artificial
  Glycine max FAD3B mutation created with TALEN pair GmFAD3_T01.1
ctcacacattgttctgttatgtcatttcttcttcatttggctttagacgtactactcttttcagatagccctttgctgaatagcctggtgggacacatcttgcattcctcaattcttgtgccataccatggatggttagttcatactggcttttttgtttgttcatttgtcattgaaaaaaatcttttgttgattcaattatttttatagtgtgtttggaagcccgtttgagaaaataagaaatcgcatctggaatgtgaaagttataactatttagcttcatttgtcgttgcaagttcttttattggttaaatttttatagcgtgctaggaaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaaccatggacacattgagaaggatgagtcatgggttccagtatgtgattaattgcttctcctatagttgttcttgattcaattacattttatttatttggtaggtccaagaaaaaagggaatctttatgcttcctgaggctgttcttgaacatggctcttttttatgtgtcattatcttagtt

SEQ ID NO: 1152 - DNA, 748 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcatatggaagcttttcagatagccctttgctgaatagcctggtgggacacatcttgcattcctcaattcttgtgccataccatggatggttagttcatactggcttttttgtttgttcatttgtcattgaaaaaaatcttttgttgattcaattatttttatagtgtgtttggaagcccgtttgagaaaataagaaatcgcatctggaatgtgaaagttataactatttagcttcatttgtcgttgcaagttcttttattggttaaaatttttatagcgtgctaggaaaacccattcgagaaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacatttttatttatttggtaggtccaagaaaaaagggaatctttatgcttcctgaggctgttcttgaacatggctctttttatgtgtcattatctta

SEQ ID NO: 1153 - DNA, 772 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaacaccatggaagcttttcagatagccctttgctgaatagcctggtgggacacatcttgcattcctcaattcttgtgccataccatggatggttagttcatactggcttttttgtttgttcatttgtcattgaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtcccaaagaaaaaaagggaatctttatgcattcctgaggtctgttcttgaacatggctcttttttatgtgtca

SEQ ID NO: 1154 - DNA, 786 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaacaccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtcccaaagaaaaaaatgggtaatcttttaatggctttcctgagggctgtttcttgaacatggctcttttttatgtgcatgatcttag

SEQ ID NO: 1155 - DNA, 690 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaatggaagcttttcagatagccctttgctgaatagcctggtgggacacatcttgcattcctcaattcttgtgccataccatggatggttagttcatactggcttttttgtttgttcatttgtcattgaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggta

SEQ ID NO: 1156 - DNA, 762 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaacatggaagcttttcagatagccctttgctgaatagcctggtgggacacatcttgcattcctcaattcttgtgccataccatggatggttagttcatactggcttttttgtttgttcatttgtcattgaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttatttgattaaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaagggaatctttatgcttcctgaggctgttcttgaacatggctcttttttatgtg

SEQ ID NO: 1157 - DNA, 660 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattatggaagcttttcagatagccctttgctgaatagcctggtgggacacatcttgcattcctcaattcttgtgccataccatggatggttagttcatactggcttttttgtttgttcatttgtcattgaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgatt

SEQ ID NO: 1158 - DNA, 747 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaattgaatagcctggtgggacacatcttgcattcctcaattcttgtgccataccatggatggttagttcatactggcttttttgtttgttcatttgtcattgaaaaaaactcttttgttgattcaattatttttatagtgtgtttggaagcccgtttgagaaaataagaaatcgcatctggaatgtgaaagttataactatttagcttcatttgtcgttgcaagttcttttattggttaaaatttttatagcgtgctaggaaaacccattcgagaaaaataagaaatcacatctggaatgtgaaagttataactgttagcttctgagtaaacgtggaaaaaccactttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacatttttattttatttgggtaggtccaagaaaaaacgggaatctttatgcttcctgaggctgttcttgaacatggctctttttatgtgtcattatctta

SEQ ID NO: 1159 - DNA, 692 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaattgaagcttttcagatagccctttgctgaatagcctggtgggacacatcttgcattcctcaattcttgtgccataccatggatggttagttcatactggcttttttgtttgttcatttgtcattgaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttgatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggta

SEQ ID NO: 1160 - DNA, 637 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattctttattatgtttttgcttatatggtaaagtgattcttcataaaaataatggaagcttttcagatagccctttgctgaatagcctggtgggacacatcttgcattcctcaattcttgtgccataccatggatggttagttcatactggcttttttgtttgttcatttgtcattgaaaaaaaagtcttttgttgattcaattatttttatagtgtgtttggaagcccgtttgagaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaatttttatttgataaaatgacaaccaaaatttgattttgatgggattttgcaggagaatttagccacagaactcaccatcaaaaccat

SEQ ID NO: 1161 - DNA, 775 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgatacatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaagccatggacacattgagaaggatgagtcatgggttccagtatgtgattaattgcttctcctatagttgttcttgattcaattacattttatttatttggtagggtccaagaaaaaatgggaatcttttatgcttcctgaggtctgttcttgaacatggctcttttttatgtgtcatatcttag

SEQ ID NO: 1162 - DNA, 884 bp, Artificial
  Glycine max FAD3B mutation created with TALEN pair GmFAD3_T01.1
ctcacacattgttctgttatgtcatttcttcttcatttggctttagacaacttaaatttgagatctttattatgttttgcttatatggtaaagtgattcttcattatttcattcttcattgattgaatgatgcatggtaggccatttcgaagcatttagcccagattttaggccctttggcaattaggaatccatgggccttgggggatcggaaccaatccttagtccatttgcccatttcccaatttccaattttgcttggtccgccaattaaccccaattgggaattggggttttaaggttttccaattaaccttgggccttttttttggttttggtttccaattttggttccaattttgaaaaaaaaatcttttgttgattccaaatttatttttatagtgtgtttggaagcccgttgagaaaataagaaatcgcatctggaatgtgaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggaagtctttatgcttcctgaggctgttcttgaacatggctcttttttatgtgtcatttatctagttaa

SEQ ID NO: 1163 - DNA, 643 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaattgtctttgttgattcaattattttatagtgtgtttggaagcccgtttgagaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaaagttataactgttagcttctgagtaaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaaaagggaatctttatgcttcctgaggctgttcttgaacatggctctttttatgtgtcattatcttagttaa

SEQ ID NO: 1164 - DNA, 689 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaattgaacagtaagcttttcagatagccctttgctgaatagcctggtgggacacatcttgcattcctcaattcttgtgccataccatggatggttagttcatactggcttttttgtttgttcatttgtcattgaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttattta

SEQ ID NO: 1165 - DNA, 772 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaattgaacagtaagcttttcagatagccctttgctgaatagcctggtgggacacatcttgcattcctcaattcttgtgccataccatggatggttagttcatactggcttttttgtttgttcatttgtcattgaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacatttttatttatttggtagggtcccaagaaaaaagggtaatctttatgcattcctgaggtctgttcttgaacatggctcttttttatgtgtca

SEQ ID NO: 1166 - DNA, 779 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaacatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgtaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaaagggaatctttatgcattcctgaggctgttcttgaacatggctcttttttatgtgtcatttatcttagttaa

SEQ ID NO: 1167 - DNA, 703 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaattgaaacatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggt

SEQ ID NO: 1168 - DNA, 779 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaattgaaatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaagccatggacacattgagaaggatgagtcatgggttccagtatgtgattaattgcttctcctatagttgttcttgattcaattacattttatttatttggtaggtccaagaaaaatgggaatctttatgcttcctgaggctgttctttgaacatgggctctttttttatgtgtcatatctag

SEQ ID NO: 1169 - DNA, 777 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaattgaacagtatatggaagcttttcagatagccctttgctgaatagcctggtgggacacatcttgcattcctcaattcttgtgccataccatggatggttagttcatactggcttttttgtttgttcatttgtcattgaaaaaaaactcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttgggaaccaaattttatttgataaatgacaaccaaattgattttgatggattttgcaggagaatttagccacagaactcaccatcaaaaccatggacacattgagaaggatgagtcatgggttccagtatgtgattaattgcttctcctatagttgttcttgattcaattacattttatttatttggtaggtccaagaaaaagggtaatctttatgcttcctgaggctgttcttgaacatggctcttttttgatgtgtca

SEQ ID NO: 1170 - DNA, 778 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgatacatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttatttgataaatgacaaccaaattgattttgatggattttgcaggagaattagccacagaactcaccatcaaaaccatggacacattgagaaaggatgagtcatgggttccagtatgtgattaattgcttctcctatagttgttcttgattcaaattacattttatttatttggtaggtccaagaaaaaagggaatctttatgcattcctgaggctgttcttgaacatggctcttttttatgtgtcattatcttagttaa

SEQ ID NO: 1171 - DNA, 706 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaattgaacccatggaagcttttcagatagccctttgctgaatagcctggtgggacacatcttgcattcctcaattcttgtgccataccatggatggttagttcatactggcttttttgtttgttcatttgtcattgaaaaaaaagtcttttgttgattcaattatttttatagtgtgtttggaagcccgtttgagaaaaattaagaaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttgatttgataaatgacaaccaaattgattttgatggattttgcaggagaattagccacagaactcaccatcaaaagccatggacacattgagaaggatgagtcatgggttccagtatgtgattaattgcttctcctatagttgttcttgattcaattacattttatttatttggta

SEQ ID NO: 1172 - DNA, 615 bp, Artificial
  Glycine max FAD3B mutation created with TALEN pair GmFAD3_T01.1
  misc_feature (609): n is a or c or t or g
ctcacacattgttctgttatgtcatttcttcttcatttggctttagacaacttaaatttgagatctttattatgtttttgcttatatggtaaagtgattcttcattatttcattcttttgttgattcaattatttttatagtgtgtttggaagcccgtttgagaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttattttatttggtaggtccaagaaaaaaacgggaatctttatgcttcctgaggctgttcttgaacatggctctttttangtgtca

SEQ ID NO: 1173 - DNA, 777 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgatacatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtcccaagaaaaaaagggtaatcttttaagcttcctgaggctgttcttgaacatggctcttttttatgtgtcatatcttagttaa

SEQ ID NO: 1174 - DNA, 781 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtcccaagaaaaaaagggtaatcttttaatgcttcctgaggctgttcttgaacatgggctctttttttatgtgtcatatcttagttaa

SEQ ID NO: 1175 - DNA, 786 bp, Artificial
  Glycine max FAD3B mutation created with TALEN pair GmFAD3_T01.1
ctcacacattgttctgttatgtcatttcttcttcatttggctttagacaacttaaatttgagatctttattatgttttttgcttatatggtaaagtgattcttcattatttcattcttcattgattgaatacaccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtcccaagaaaaagggtaatctttatgcattcctgaggctgttcttgaacatggctcttttttatgtgtcatttatcttagttaa

SEQ ID NO: 1176 - DNA, 760 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattatggaagcttttcagatagccctttgctgaatagcctggtgggacacatcttgcattcctcaattcttgtgccataccatggatggttagttcatactggcttttttgtttgttcatttgtcattgaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggaatctttatgcattcctgaggtctgttcttgaacatggctcttttttatgtgtcattatc

SEQ ID NO: 1177 - DNA, 685 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaacctgaatggaagcttttcagatagccctttgctgaatagcctggtgggacacatcttgcattcctcaattcttgtgccataccatggatggttagttcatactggcttttttgtttgttcatttgtcattgaaaaaaaagtcttttgttgattcaattatttttatagtgtgtttggaagcccgtttgagaaaaattaagaaaatcgcatctggaatgtgaaaagttataactatttagcttcatttgtcgttgcaagttcttttattggttaaatttttatagcgtgctaggaaacccattcgagaaaaataagaaatcacatctggaatgtgaaagttataactgttagcttctgagtaaacgtggaaaaaatccacattttggatttggaaaccaaaattttatttgataaatgacaaccaaattgattttgatggattttgcaggagaattagccacagaactcaccatcaaaaagccatggacacattgagaaggatgagtcatgggttccagtatgtgattaattgcttctcctatagttgttcttgattc

SEQ ID NO: 1178 - DNA, 751 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaattgaacagtaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttatttgataaatgacaaccaaattgattttgatggattttgcaggagaattagccacagaactcaccatcaaaaccatggacacattgagaaaggatgagtcatgggttccagtatgtgattaattgcttctcctatagttgttcttgattcaattacattttatttatttggtagggtccaagaaaaaaaggggtaatttctttttaatggccagttttcccttgg

SEQ ID NO: 1179 - DNA, 763 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaattgaacatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaaagggtaatctttatgcattcctgaggtctgttcttgaacatggctcttttt

SEQ ID NO: 1180 - DNA, 779 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattcatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtcccaagaaaaaagggtaatctttatgcattcctgaggctgttcttgaacatggctcttttttatgtgtcatttatcttagttaa

SEQ ID NO: 1181 - DNA, 617 bp, Artificial
  Glycine max FAD3B mutation created with TALEN pair GmFAD3_T01.1
  misc_feature (608): n is a or c or t or g
ctcacacattgttctgttatgtcatttcttcttcatttggctttagacaacttaaatttgagatctttattatgtttttgcttatatggtaaagtgattcttcattatttcattcttttgttgattcaattattttatagtgtgtttggaagcccgtttgagaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttattttatttggtaggtccaagaaaaaaagggaatctttatgcttcctgaggctgttcattgaacatggctctttttangtgtcatta

SEQ ID NO: 1182 - DNA, 703 bp, Artificial
  Glycine max FAD3B mutation created with TALEN pair GmFAD3_T01.1
ctcacacattgttctgttatgtcatttcttcttcattgattgaattgaaccatggaagcttttcagatagccctttgctgaatagcctggtgggacacatcttgcattcctcaattcttgtgccataccatggatggttagttcatactggcttttttgtttgttcatttgtcattgaaaaaaagtcttttgttgattcaattatttttatagtgtgtttggaagcccgtttgagaaaataagaaatcgcatctggaatgtgaaagttataactatttagcttcatttgtcgttgcaagttcttttattggttaaatttttatagcgtgctaggaaaacccattcgagaaaataagaaatcacatctggaatgtgaaagttataactgttagcttctgagtaaacgtggaaaaaaccacattttggattttggaaccaaattttatttgataaatgacaaccaaattgattttgatggattttgcaggagaattagccacagaactcaccatcaaaaaccatggacacattgagaaggatgagtcatgggttccagtatgtgattaatttgcttctcctatagttgttcttgattcaattacattttatttatttggtaggtccaagaaaaaaaggggaatctttatgcttcctgaggctgttcttgaacatggctcttttttcatgtgtcattatcttagtt

SEQ ID NO: 1183 - DNA, 697 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaatacccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggta

SEQ ID NO: 1184 - DNA, 767 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcatatggaagcttttcagatagccctttgctgaatagcctggtgggacacatcttgcattcctcaattcttgtgccataccatggatggttagttcatactggcttttttgtttgttcatttgtcattgaaaaaaactcttttgttgattcaattatttttatagtgtgtttggaagcccgtttgagaaaataagaaatcgcatctggaatgtgaaagttataactatttagcttcatttgtcgttgcaagttcttttattggttaaaatttttatagcgtgctaggaaaacccattcgagaaaataagaaatcacatctggaatgtgaaagttataactgttagcttctgagtaaacgtggaaaaatccacatttttgggatttttgggaaacccaaaaattttattttgataaaatgacaaccaaattgatttttgatggattttgcaggagaattagccacagaactcaccatcaaaaccatggacacattgagaaggatgagtcatgggtttccagtatgtgattaattgcttctcctatagttgttcttgattcaattacatttttattttatttggtaggtccaagaaaaagggaatctttatgcttcctgaggctgttcttgaacatggctctttttatgtgtcattatcttagttaa

SEQ ID NO: 1185 - DNA, 763 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggtaatctttatgcattcctgaggtctgttcttgaacatggctcttttttatgtgtca

SEQ ID NO: 1186 - DNA, 702 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaatccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccc

SEQ ID NO: 1187 - DNA, 681 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaattgaaatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattaca

SEQ ID NO: 1188 - DNA, 781 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtcccaagaaaaaaatgggtaatcttttaatgcttcctgaggtctgttcttgaacatggctcttttttatgtgtcatatcttagttaa

SEQ ID NO: 1189 - DNA, 753 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaatgggaatctttatgcttcctgaggctgttcttgaacatggctctttttt

SEQ ID NO: 1190 - DNA, 782 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaattgaacagtaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaaagggaatctttatgcttcctgaggctgttcttgaacatggctcttttttatgtgtcatttatcttagttaa

SEQ ID NO: 1191 - DNA, 773 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaatccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaaagggaatctttatgcattcctgaggtctgttcttgaacatggctcttttttatgtgtcattatc

SEQ ID NO: 1192 - DNA, 741 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgatacatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaagccatggacacattgagaaggatgagtcatgggttccagtatgtgattaattgcttctcctatagttgttcttgattcaattacattttatttatttggtaggtccaagaaaaatgggaatctttatgcttcctgaggctgttcttgaaca

SEQ ID NO: 1193 - DNA, 618 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttttgttgattcaattatttttatagtgtgtttggaagcccgtttgagaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttattttatttggtaggtccaagaaaaaaacgggaatctttatgcttcctgaggctgttcttgaacatggctctttttagtgtcattat

SEQ ID NO: 1194 - DNA, 777 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaatggaagctttcagatagccctttgctgaatagcctggtgggacacatcttgcattcctcaattcttgtgccataccatggatggttagttcatactggcttttttgtttgttcatttgtcattgaaaaaaatcttttgttgattcaattatttttatagtgtgtttggaagcccgtttgagaaaaattaagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaaaatgggtaatcttttatgcttcctgaggctgttcttgaacatggctcttttttatgtgcattatcttagttaa

SEQ ID NO: 1195 - DNA, 756 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaattgaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaaaatgggaatctttatgcttcctgaggctgttcttgaacatggctctttttt

SEQ ID NO: 1196 - DNA, 777 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaattgaacagtatatggaagcttttcagatagccctttgctgaatagcctggtgggacacatcttgcattcctcaattcttgtgccataccatggatggttagttcatactggcttttttgtttgttcatttgtcattgaaaaaaactcttttgttgattcaattatttttatagtgtgtttggaagcccgtttgagaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttgggaaccaaattttatttgataaatgacaaccaaattgattttgatggattttgcaggagaattagccacagaatctcaccatcaaaaccatggacacattgagaaggatgagtcatgggttccagtatgtgattaattgcttctcctatagttgttcttgattcaattacattttatttatttggtaggtccaagaaaaagggtaatctttatgcttcctgaggctgttcttgaacatggctcttttttatgtgtcatta

SEQ ID NO: 1197 - DNA, 764 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaagggtaatctttatgcattcctgaggtctgttcttgaacatggctcttttttatgtgtca

SEQ ID NO: 1198 - DNA, 760 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaatggaagcttttcagatagccctttgctgaatagcctggtgggacacatcttgcattcctcaattcttgtgccataccatggatggttagttcatactggcttttttgtttgttcatttgtcattgaaaaaaatcttttgttgattcaattatttttatagtgtgtttggaagcccgtttgagaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaagggaatctttatgcattcctgaggctgttcttgaacatggctcttttttatgtgtca

SEQ ID NO: 1199 - DNA, 760 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaattgcatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaaagggaatctttatgcattcctgaggctgttcttgaacatggctcttttt

SEQ ID NO: 1200 - DNA, 671 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaacctgaatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttga

SEQ ID NO: 1201 - DNA, 773 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaatacccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaatgggatctttatgcttcctgaggctgttcttgaacatgggctcttttttatgtgtcatatcta

SEQ ID NO: 1202 - DNA, 775 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaatggaagcttttcagatagccctttgctgaatagcctggtgggacacatcttgcattcctcaattcttgtgccataccatggatggttagttcatactggcttttttgtttgttcatttgtcattgaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaagggtaatctttatgcattcctgaggctgttcttgaacatggctcttttttatgtgtcattatcttagttaa

SEQ ID NO: 1203 - DNA, 775 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaattgaacagtaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacatttttatttatttgggtagggtcccaagaaaaaaagggtaatctttatgcattcctgaggctgttcttgaacatggctcttttttatgtgtca

SEQ ID NO: 1204 - DNA, 686 bp, Artificial
  Glycine max FAD3B mutation created with TALEN pair GmFAD3_T01.1
ctcacacattgttctgttatgtcatttcttcttcattgattgaattgaaccatggaagcttttcagatagccctttgctgaatagcctggtgggacacatcttgcattcctcaattcttgtgccataccatggatggttagttcatactggcttttttgtttgttcatttgtcattgaaaaaaagtcttttgttgattcaattatttttatagtgtgtttggaagcccgtttgagaaaataagaaatcgcatctggaatgtgaaagttataactatttagcttcatttgtcgttgcaaagttcttttattggttaaatttttatagcgtgctaggaaaacccattcgagaaaataagaaatcacatctggaatgtgaaagttataactgttagcttctgagtaaacgtggaaaaaaccacattttggattttggaaccaaattttatttgataaatgacaaccaaaattgattttgatggattttgcaggagaaattagccacagaactcaccatcaaaaaccatggacacattgagaagggatgagtcatgggttccagtatgtgattaattgcttctcctatagttgtcttgattcaattacattttatttatttggtaggtccaagaaaaaaaggggtaatctttatgcttcctgaggctgttcttgaacatggctctttttt

SEQ ID NO: 1205 - DNA, 777 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtcccaagaaaaagggtaatctttatgcattcctgaggctgttcttgaacatggctcttttttatgtgtcattatcttagttaa

SEQ ID NO: 1206 - DNA, 758 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattggaagcttttcagatagccctttgctgaatagcctggtgggacacatcttgcattcctcaattcttgtgccataccatggatggttagttcatactggcttttttgtttgttcatttgtcattgaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtcccaagaaaaaagggtaatctttatgcattcctgaggctgttcttgaacatggctcttttttatgtgtcatt

SEQ ID NO: 1207 - DNA, 775 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaattgaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaagggaatctttatgcattcctgaggctgttcttgaacatggctcttttttatgtgtcattatcttagttaa

SEQ ID NO: 1208 - DNA, 775 bp, Artificial; identical to SEQ ID NO: 1202
  Glycine max FAD3B mutation created with TALEN pair GmFAD3_T01.1

SEQ ID NO: 1209 - DNA, 684 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaatacccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaagccatggacacattgagaaggatgagtcatgggttccagtatgtgattaattgcttctcctatagttgttcttgattcaattaca

SEQ ID NO: 1210 - DNA, 702 bp, Artificial
  Glycine max FAD3B mutation created with TALEN pair GmFAD3_T01.1
ctcacacattgttctgttatgtcatttcttcttcatttggctttagacaacttaaatttgagatctttattatgttttttgcttatatggtaaagtgattcttcattatttcattcttcattgatttgacgtcaattaaatcaaaaggcttttcagatagcccttttgctgaatagcctggtgggacacatcttgcattcctcaattcttgtgccataccatggatggttagttcatactggctttttttgtttgttcatttgtcattgaaaaaaaagtcttttgttgattcaattattttttatagtgtgtttggaagcccgtttgagaaaaattaagaaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaagccatggacacattgagaaggatgagtcatgggttccagtatgtgattaattgcttctcctatagttgttcttgattcaattacatttta

SEQ ID NO: 1211 - DNA, 507 bp, Artificial
  Glycine max FAD3B mutation created with TALEN pair GmFAD3_T01.1
ctcacacattgttctgttatgtcatttcttcttcatttggctttagacaacttaaatttgagatctttattatgtttcagatagccctttgctgaatagcctggtgggacacatcttgcattcctcaattcttgtgccataccatggatggttagttcatactggcttttttgtttgttcatttgtcattgaaaaaaatcttttgttgattcaattatttttatagtgtgtttggaagcccgtttgagaaaataagaaatcgcatctggaatgtgaaagttataactatttagcttcatttgtcgttgcaagttcttttattggttaaaatttttatagcgtgctaggaaacccattcgagaaaataagaaatcacatctggaatgtgaaagttataactgttagcttctgagtaaacgtggaaaaaccacattttggatttggaaccaaaattttatttgataaatgacaaccaaattgattttgattggatttgcatggagaatt

SEQ ID NO: 1212 - DNA, 765 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaattgaacagtaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaaagaaaaaaagggtaatcttttatgcattcctgaggctgttcttgaacatggctctttttt

SEQ ID NO: 1213 - DNA, 776 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggtaatctttatgcattcctgaggctgttcttgaacatggctcttttttatgtgtcatttatcttagttaa

SEQ ID NO: 1214 - DNA, 646 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaattgaaattgcattcctcaattcttgtgccataccatggatggttagttcatactggctttttgtttgttcatttgtcattgaaaaaatctttgttgattcaattatttttatagtgtgtttggaagcccgtttgagaaaataagaaatcgcatctggaatgtgaaagttataactatttagcttcatttgtcgttgcaagttcttttattggttaaaatttttatagcgtgctaggaaaacccattcgagaaaataagaaatcacatctggaatgtgaaagttataactgttagcttctgagtaaacgtggaaaaaaccacattttggatttggaaccaaatttatttgataaatgacaaccaaatttgattttgatggattttgcaggagaattagccacagaactcaccatcaaaaccatggacacattgagaaggatgagtcatgggttccagtatgtgattaattgcttctcctatagttgttcttgattcaattacattttatttatttggta

SEQ ID NO: 1215 - DNA, 765 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattggcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaagggaatctttatgcattcctgaggtctgttcttgaacatggctcttttttatgtgtcattatcttagttaa

SEQ ID NO: 1216 - DNA, 780 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaattgaccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtcccaagaaaaaaatgggaatctttatgcttcctgaggctgttcttgaacatggctcttttttatgtgcattatcttag

SEQ ID NO: 1217 - DNA, 763 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaagggtaatctttatgcattcctgaggctgttcttgaacatggctcttttttatgtgtca

SEQ ID NO: 1218 - DNA, 773 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaattgaaaagcttttcagatagccctttgctgaatagcctggtgggacacatcttgcattcctcaattcttgtgccataccatggatggttagttcatactggctttttttgtttgttcatttgtcattgaaaaaaaagtcttttgttgattcaattatttttatagtgtgtttggaagcccgtttgagaaaaataagaaatcgcatctggaatgtgaaaagttataactatttagcttcatttgtcgttgcaagttcttttattggttaaaatttttatagcgtgctaggaaacccattcgagaaaataagaaatcacatctggaatgtgaaagttataactgttagcttctgagtaaaacgtggaaaaaaccacattttggatttggaaaccaaaaatttttattttgataaaatgacaaccaaaattgatttttgatggattttgcaggagaattagccacagaactcaccatcaaaaaccatggacacattgagaaggatgagtcatgggttccagtatgtgattaattgcttctcctatagttgttcttgattcaattacattttatttatttggtaggtccaagaaaaaatgggaatcttttatgcttcctgaggctgttcttgaacatggctcttttttt

SEQ ID NO: 1219 - DNA, 677 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaattgaacagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattaca

SEQ ID NO: 1220 - DNA, 772 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaattgaacagtaagcttttcagatagccctttgctgaatagcctggtgggacacatcttgcattcctcaattcttgtgccataccatggatggttagttcatactggcttttttgtttgttcatttgtcattgaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggtaatctttatgcattcctgaggtctgttcttgaacatggctcttttttatgtgtcattta

SEQ ID NO: 1221 - DNA, 706 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaatccagcgcctgttgccggtgctgtgccaggcccacggcttgaccccggagcaggtggtggccatcgccagccacgatggaagcttttcagatagccctttgctgaatagcctggtgggacacatcttgcattcctcaattcttgtgccataccatggatggttagttcatactggcttttttgtttgttcatttgtcattgaaaaaaagtcttttgttgattcaattatttttatagtgtgtttggaagcccgtttgagaaaataagaaatcgcatctggaatgtgaaagttataactatttagcttcatttgtcgttgcaagttcttttattggttaaatttttatagcgtgctaggaaacccattcgagaaaaataagaaatcacatctggaatgtgaaagttataactgttagcttctgagtaaaacgtggaaaaaccacattttgggatttggaaccaaatttatttgataaatgacaaccaaattgatttgatggatttgcaggagaattagccacagaactcaccatcaaaaccatggacacattgagaaggatgagtcatgggttccagta

SEQ ID NO: 1222 - DNA, 698 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaaccatggaagcttttcagatagccctttgctgaatagcctggtgggacacatcttgcattcctcaattcttgtgccataccatggatggttagttcatactggcttttttgtttgttcatttgtcattgaaaaaaaagtcttttgttgattcaattatttttatagtgtgtttggaagcccgtttgagaaaaataagaaatcgcatctggaatgtgaaaagttataactatttagcttcatttgtcgttgcaagttcttttattggttaaaatttttatagcgtgctaggaaacccattcgagaaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggta

SEQ ID NO: 1223 - DNA, 772 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaattgaaaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaaatgggaatctttatgcttcctgaggctgttcttgaacatggctcttttttatgtgcattatctta

SEQ ID NO: 1224 - DNA, 760 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaatccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacatttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtcccaaaaaaaagggtaatctttatgcattcctgaggctgttcttgaacatggctctttttaa

SEQ ID NO: 1225 - DNA, 717 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaatccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaaagggtaat

SEQ ID NO: 1226 - DNA, 482 bp, Artificial
  Glycine max FAD3B mutation created with TALEN pair GmFAD3_T01.1
ctcacacattgttctgttatgtcatttcttcttcatttggctttagacaacttaaatttgagatctttattatgtttcagatagccctttgctgaatagcctggtgggacacatcttgcattcctcaattcttgtgccataccatggatggttagttcatactggcttttttgtttgttcatttgtcattgaaaaaatcttttgttgattcaattattttatagtgtgtttggaagcccgtttgagaaataagaaatcgcatctggaatgtgaaagttataactatttagcttcatttgtcgttgcaaagttcttttattggttaaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgatttt

SEQ ID NO: 1227 - DNA, 801 bp, Artificial
  Glycine max FAD3B mutation created with TALEN pair GmFAD3_T01.1
ctcacacattgttctgttatgtcatttcttcttcatttggctttagacaacttaaatttgagatctttattatgttttgcttatatggtaaagtgattcttcattatttcattcttcattgattgaaatgatcgcatggtaggccatttcgaagcattttagcccagatttaggccccttttggcaattaggaatccatgggccttgggggatcgggaaccaatccttagtccattttgcccatttcccaatttccaattttgctttggtccgccaattaaccccaattgggaattgggttttagtttcatactggctttttttgtttgttcatttgttcattgaaaaaaaatcttttgttgattcaattatttttatagtgtgtttggaagcccgtttgagaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggaatc

SEQ ID NO: 1228 - DNA, 713 bp, Artificial
  Glycine max FAD3B mutation created with TALEN pair GmFAD3_T01.1
ctcacacattgttctgttatgtcatttcttcttcatttggctttagacgtactactcttttcagatagccctttgctgaatagcctggtgggacacatcttgcattcctcaattcttgtgccataccatggatggttagttcatactggcttttttgtttgttcatttgtcattgaaaaaaagtcttttgttgattcaattatttttatagtgtgtttggaagcccgtttgagaaaataagaaatcgcatctggaatgtgaaagttataactatttagcttcatttgtcgttgcaagttcttttattggttaaatttttatagcgtgctaggaaaacccattcgagaaaaataagaaatcacatctggaatgtgaaagttataactgttagcttctgagtaaacgtggaaaaaaccacattttggatttggaaccaaattttatttgataaatgacaaccaaattgattttgatggattttgcaggagaattagccacagaactcaccatcaaaaaccatggacacattgagaaggatgagtcatgggttccagtatgtgattaattgcttctcctatagttgttcttgattcaattacattttatttatttggtaggtccaagaaaaaaaggggaatctttatgcttcctgaggctgttcttgaacatggctcttttttcatgtgtcattatcttagttaacctgagactca

SEQ ID NO: 1229 - DNA, 671 bp, Artificial
  Glycine max FAD3B mutation created with TALEN pair GmFAD3_T01.1
ctcacacattgttctgttatgtcatttcttcttcatttggctttagacaacttaaatttgagatctttattatattttttcagatagccctttgctgaatagcctggtgggacacatcttgcattcctcaattcttgtgccataccatggatggttagttcatactggcttttttgtttgttcatttgtcattgaaaaaatcttttgttgattcaattatttttatagtgtgtttggaagcccgtttgagaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaaagggaatctttatgcttcctgaggctgtt

SEQ ID NO: 1230 - DNA, 700 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaattgaatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggt

SEQ ID NO: 1231 - DNA, 744 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattggcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaaagggtaatctttatgcttcctgaggctgttcttgaacatggctctttttt

SEQ ID NO: 1232 - DNA, 765 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaacatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggtaatctttatgcattcctgaggctgttcttgaacatggctcttttttaatgtgtca

SEQ ID NO: 1233 - DNA, 677 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattatggaagcttttcagatagccctttgctgaatagcctggtgggacacatcttgcattcctcaattcttgtgccataccatggatggttagttcatactggcttttttgtttgttcatttgtcattgaaaaaaaagtcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaatccacattttggatttggaaccaaattttgatttgataaatgacaaccaaattgattttgatggattttgcaggagaattagccacagaactcaccatcaaaagccatggacacattgagaaggatgagtcatgggttccagtatgtgattaattgcttctcctatagttgttcttgattcaattaca

SEQ ID NO: 1234 - DNA, 787 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaatccagcgcctgttgccggtgctgtgccaggcccacggcttgaccccggagcaggtggtggccatcgccagccacgatggaagcttttcagatagccctttgctgaatagcctggtgggacacatcttgcattcctcaattcttgtgccataccatggatggttagttcatactggcttttttgtttgttcatttgtcattgaaaaaaatcttttgttgattcaattatttttatagtgtgtttggaagcccgtttgagaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttgggatttggaaccaaattttatttgataaatgacaaccaaattgattttgatggatttgcaggaagaattagccacagaactcaccatcaaaatccatggacacatttgagaaaggatgagtcatgggttccaagtatgtgattaattgcttctcctatagttgttcttgattcaattacattttattatttggtaggtccaagaaaaagggaa

SEQ ID NO: 1235 - DNA, 768 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaagggaatctttatgcttcctgaggctgttcttgaacatggctcttttttatgtgtcatatcttagttaa

SEQ ID NO: 1236 - DNA, 687 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaattgtgcattcctcaattcttgtgccataccatggatggttagttcatactggcttttttgtttgttcatttgtcattgaaaaaattcttttgttgattcaattattttatagtgtgtttggaagcccgtttgagaaaataagaaatcgcatctggaatgtgaaagttataactatttagcttcatttgtcgttgcaagttcttttattggttaaaatttttatagcgtgctaggaaacccattcgagaaaattaagaaatcacatctggaatgtgaaagttataactgttagcttctgagtaaacgtggaaaaaaccacattttggatttggaaccaaattttatttgataaatgacaaccaaatttgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaaagggaatctttatgcttcctgaggctgtt

SEQ ID NO: 1237 - DNA, 772 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaagggtaatctttatgcattcctgaggtctgttcttgaacatggctcttttttatgtgtcattatcttagttaa

SEQ ID NO: 1238 - DNA, 770 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaagggaatctttatgcttcctgaggtctgttcttgaacatggctcttttttatgtgtcattatcttagttaa

SEQ ID NO: 1239 - DNA, 764 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaattggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggtaatctttatgcattcctgaggtctgttcttgaacatggctcttttttatgtgtca

SEQ ID NO: 1240 - DNA, 767 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattgattgaatttgaatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggtaatctttatgcattcctgaggtctgttcttgaacatggctcttttttatgtgtcattatcttagttaa

SEQ ID NO: 1241 - DNA, 693 bp, Artificial
  Glycine max FAD3B mutation created with TALEN pair GmFAD3_T01.1
ctcacacattgttctgttatgtcatttcttcttcatttggctttagacaacttaaatttcagatagccctttgctgaatagcctggtgggacacatcttgcattcctcaattcttgtgccataccatggatggttagttcatactggcttttttgtttgttcatttgtcattgaaaaaaatcttttgttgattcaattatttttatagtgtgtttggaagcccgtttgagaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaacttcaccatcaaaaaccatggacacattgagaaggatgagtcatgggttccagtatgtgattaattgcttctcctatagttgttcttgattcaattacattttatttatttggtaggtccaagaaaaaaagggaatctttatgcttcctgaggctgttcttgaacatggctcttttttatgtgtcattatcttagtt

SEQ ID NO: 1242 - DNA, 755 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattctcatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaaagggtaatctttatgcattcctgaggctgttcttgaacatggctcttttttatgtgtca

SEQ ID NO: 1243 - DNA, 712 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaacatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagaccacatgaactcatccatcaaaaccatggacacattgagaaggatgagtcatgggttccagtatgtgattaattgcttctcctatagttgttcttgattcaattacatttatttatttggtagggttccaatgaaaaaa

SEQ ID NO: 1244 - DNA, 696 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaattgaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggt

SEQ ID NO: 1245 - DNA, 613 bp, Artificial
  Glycine max FAD3B mutation created with TALEN pair GmFAD3_T01.1
ctcacacattgttctgttatgtcatttcttcttcatttggctttagacaacttaaatttgagatctttattatgtttcagatagccctttgctgaatagcctggtgggacacatcttgcattcctcaattcttgtgccataccatggatggttagttcatactggcttttttgtttgttcatttgtcattgaaaaaatcttttgttgattcaattatttttatagtgtgtttggaagcccgtttgagaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaaccacattttggatttggaaccaaattttatttgataaattgacaaccaaattgattttgattggattttgcatggagaattagcacagaactcaccatcaaaccatggaacacattgagaatggatgagtcatgggttccagtatgtgattaattgcttctcctatagttgttcttgattcaattaca

SEQ ID NO: 1246 - DNA, 674 bp, Artificial
  Glycine max FAD3B mutation created with TALEN pair GmFAD3_T01.1
ctcacacattgttctgttatgtcatttcttcttcatttggctttagacaacttaaatttgagatctttattatgtttcagatagccctttgctgaatagcctggtgggacacatcttgcattcctcaattcttgtgccataccatggatggttagttcatactggcttttttgtttgttcatttgtcattgaaaaaaatcttttgttgattcaattatttttatagtgtgtttggaagcccgtttgagaaaataagaaatcgcatctggaatgtgaaagttataactatttagcttcatttgtcgttgcaagttcttttattggttaaaatttttatagcgtgctaggaaacccattcgagaaaataagaaatcacatctggaatgtgaaagttataactgttagcttctgagtaaacgtggaaaaaaccacattttggatttggaaccaaattttatttgataaatgacaaccaaattgattttgattggatttgcatggagaattagcacagaactcaccatcaaaaccatggaacacattgagaatggatgagtcatgggttccagtatgtgattaattgcttctcctatagttgttcttgattcaattacattttatttatttggtaggtccaagaaaaaaagggaatctttatgcttcctgaggctgtt

SEQ ID NO: 1247 - DNA, 765 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaattgaccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaaagggtaatctttatgcattcctgaggctgttcttgaacatggctcttttttat

SEQ ID NO: 1248 - DNA, 762 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaattgaaatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaagggtaatctttatgcattcctgaggtctgttcttgaacatggctctttttt

SEQ ID NO: 1249 - DNA, 764 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattcatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttgggtagggtccaagaaaaagggtaatctttatgcattcctgaggtctgttcttgaacatggctcttttttatgtgtca

SEQ ID NO: 1250 - DNA, 767 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaattgcatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttgggtagggtccaagaaaaagggaatctttatgcttcctgaggctgttcttgaacatggctcttttttatgtgtca

SEQ ID NO: 1251 - DNA, 694 bp, Artificial
  Glycine max FAD3B mutation created with TALEN pair GmFAD3_T01.1
ctcacacattgttctgttatgtcatttcttcttcatttggctttagacaacttaaatttgagatctttattatgttttttgcttatatggtaaagtgattcttcattatttcattcttcattgatttgacgtcaattaaatcaaaaggcttttcagatagcccttttgctgaatagcctggtgggacacatcttgcattcctcaattcttgtgccataccatggatggttagttcatactggctttttttgtttgttcatttgtcattgaaaaaaaaatcttttgttgattcaattattttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattaca

SEQ ID NO: 1252 - DNA, 777 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaattgaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaagggtaatctttatgcattcctgaggtctgttcttgaacatggctcttttttatgtgtcattatcttagttaa

SEQ ID NO: 1253 - DNA, 703 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaatggaagcttttcagatagccctttgctgaatagcctggtgggacacatcttgcattcctcaattcttgtgccataccatggatggttagttcatactggcttttttgtttgttcatttgtcattgaaaaaaaagtcttttgttgattcaattatttttatagtgtgtttggaagcccgtttgagaaaaattaagaaaatcgcatctggaatgtgaaaagttataactatttagcttcatttgtcgttgcaagttcttttattggttaaatttttcatagcgtgctaggaaacccattcgagaaaagtaagaaattcacatctggaatgtgaaagttataactgttagcttctgagtaaacgtggaaaaatccacattttggatttggaaccaaattttgatttgataaatgacaaccaaagttgattttgatggattttgcaggagaattagccacagaactcaccatcaaaagccaatggacacattgagaaggatgagtcatgggttccagtatgtgattaattgcttctcctatagttgttcttgattcaattacattttatttatttggta

SEQ ID NO: 1254 - DNA, 610 bp, Artificial
  Glycine max FAD3B mutation created with TALEN pair GmFAD3_T01.1
ctcacacattgttctgttatgtcatttcttcttcatttggctttagacaacttaaatttgagatctttattatgtttcagatagccctttgctgaatagcctggtgggacacatcttgcattcctcaattcttgtgccataccatggatggttagttcatactggcttttttgtttgttcatttgtcattgaaaaaatcttttgttgattcaattattttatagtgtgtttggaagcccgtttgagaaataagaaatcgcatctggaatgtgaaagttataactatttagcttcatttgtcgttgcaaagttcttttattggttaaaatttttatagcgtgctaggaaacccattcgagaaaataagaaatcacatctggaatgtgaaagttataactgttagcttctgagtaaacgtggaaaaaccacattttggaatttggaaccaaatttatttgataaatgacaaccaaattgattttgattggattttgcatggagaattagccacagaactcaccatcaaaaccatggcaacacgattgagaaggatgagtcatgggttccagtatgtgattaattgcttctcctatagttgttcttgattcaa

SEQ ID NO: 1255 - DNA, 779 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaattgaacagtaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaaaagggaatcttttatgcttcctgaggctgttctttgaacatggctctttttttatgtgtcatatctag

SEQ ID NO: 1256 - DNA, 774 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaattgaaatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaaaagggaatctttatgcttcctgaggctgttcttgaacatggctcttttttatgtgcattatc

SEQ ID NO: 1257 - DNA, 712 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaaccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtcccaaagaaaaaaa

SEQ ID NO: 1258 - DNA, 779 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaaccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaagggtaatctttatgcattcctgaggtctgttcttgaacatggctctttttatgtgtcattatcttagttaa

SEQ ID NO: 1259 - DNA, 727 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaattgaacagtaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggaatttggaaccaaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacatttttatttatttggtagggtccaagaaaaaagggtaatctttt

SEQ ID NO: 1260 - DNA, 696 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaatccatggaagcttttcagatagccctttgctgaatagcctggtgggacacatcttgcattcctcaattcttgtgccataccatggatggttagttcatactggcttttttgtttgttcatttgtcattgaaaaaaaagtcttttgttgattcaattatttttatagtgtgtttggaagcccgtttgagaaaaattaagaaaatcgcatctggaatgtgaaaagttataactatttagcttcatttgtcgttgcaagttcttttattggttaaatttttatagcgtgctaggaaacccatttcgagaaaaagtaagaaattcacatctggaatgtgaaagttataactgttaagcttctgagtaaacgtggaaaaatccacattttggatttggaaccaaaattttgatttgataaaattgacaaccaaagttgattttgatggattttgcaggagaattagccacagaactcaccatcaaaagccaatggacacattgagaaggatgagtcatgggttccagtatgtgattaattgcttctcctatagttgttcttgattcaattaca

SEQ ID NO: 1261 - DNA, 755 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaaatgggaatctttatgcttcctgaggctgttcttgaacatggctctttttt

SEQ ID NO: 1262 - DNA, 778 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaaatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaataagccacagaactcaccatcaaaaccatggacacattgagaaggatgagtcatgggttccagtatgtgattaattgcttctcctatagttgttcttgattcaattacattttatttatttggtagggtcccaagaaaaagggtaatctttatgcattcctgaggtctgttcttgaacatggctctttttatgtgtcattatcttagttaa

SEQ ID NO: 1263 - DNA, 771 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaattgaaacatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaaatttttatagcgtgctaggaaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaatgggtaatctttatgcttcctgaggctgttcttgaacatggctcttttttatgtgca

SEQ ID NO: 1264 - DNA, 685 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattggcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggt

SEQ ID NO: 1265 - DNA, 778 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaattgaaaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaagggtaattcttttatgcttcctgaggctgttcttgaacatggctcttttttatgtgcattatcttagttaa

SEQ ID NO: 1266 - DNA, 763 bp, Artificial
  Glycine max FAD3B mutation created with TALEN pair GmFAD3_T01.1
  misc_feature (292): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggaatctttatgcttcctgaggctgttcttgaacatggctcttttt

SEQ ID NO: 1267 - DNA, 793 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgagaattcatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggatgaattagccacatgaactcaccatcaaaaccatggacacattgagaaggatgagtcatgggttccagtatgtgattaattgcttctcctatagttgttcttgattcaattacattttatttatttggtagggttccaatgaaaaaagggtaaagagttcttttatggcattccctgagggctgttcttgaaacatggctctttttttatgtgtcattatctagttaa

SEQ ID NO: 1268 - DNA, 637 bp, Artificial
  Glycine max FAD3B mutation created with TALEN pair GmFAD3_T01.1
ctcacacattgttctgttatgtcatttcttcttcatttggctttagacaacttaaatttgagatctttattatgtttcagatagccctttgctgaatagcctggtgggacacatcttgcattcctcaattcttgtgccataccatggatggttagttcatactggcttttttgtttgttcatttgtcattgaaaaaaattcttttgttgattcaattatttttatagtgtgtttggaagcccgtttgagaaaataagaaatcgcatctggaatgtgaaagttataactatttagcttcatttgtcgttgcaaagttcttttattggttaaatttttatagcgtgctaggaaacccattcgagaaaataagaaatcacatctggaatgtgaaagttataactgttagcttctgagtaaacgtggaaaaaaccacattttggatttggaaccaaattttatttgataaattgacaaccaaattgattttgattggattttgcatggagaattgagcaacagaactcaccatcaaaaccatggaacacgattgagaaggatgagtcatgggttccagtatgtgattaattgcttctcctatagttgttcttgattcaagttacattttatttatttggta

SEQ ID NO: 1269 - DNA, 867 bp, Artificial
  Glycine max FAD3B mutation created with TALEN pair GmFAD3_T01.1
  misc_feature (804): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacaggcgctgttgccggtgctgtgccaggcccacggcttgaccccggagcaggtggtggccatcgccagcaatattggtggcaagcaggcgctggagacggtgcaggcgctgttgccgtgcatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattattttatagtgtgtttggaagcccgtttgagaaaattaagaatcgcatctggaatgtgaagttataactatttagcttcatttgtcgttgcaagttcttttattggttaaatttttatagcgtgctaggaacccattcgaagaataagaaatcacatctggaatgtgaaagttataactgttagcttctgagtaaacgtggaaaaaccacattttggatttggaaccaaattttatttgattaaatgacaaccaattgattttgatggattttgcaggagaatttagccacagaatctcaccatcaaaatccatggacacattgagaaggatgagtcatgggttccagtatgtgattaattgcttctcctatagttgttcttgattcaattacattttntttatttggtaggtccaaagaaaaatgggaatctttatgcttcctgaggctgttcttagaaca

SEQ ID NO: 1270 - DNA, 724 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaattgaacatggaagcttttcagatagccctttgctgaatagcctggtgggacacatcttgcattcctcaattcttgtgccataccatggatggttagttcatactggcttttttgtttgttcatttgtcattgaaaaaaaagtcttttgttgattcaattatttttatagtgtgtttggaagcccgtttgagaaaaattaagaaaatcgcatctggaatgtgaaagttataactatttagcttcatttgtcgttgcaagttcttttattggttaaatttttatagcgtgctaggaaacccattcgagaaaaagtaagaaattcacatctggaatgtgaaagttataactgttaagcttctgagtaaacgtggaaaaatccacattttggatttggaaccaaattttgatttgataaatgacaaccaaagttgattttgattggattttgcaggagaattagccacagaactcaccatcaaaagccatggacacattgagaaggatgagtcatgggttccagtatgtgattaattgcttctcctatagttgttcttgattcaattacattttatttatttggtaggtccaagaaaaat

SEQ ID NO: 1271 - DNA, 698 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaatccatggaagcttttcagatagccctttgctgaatagcctggtgggacacatcttgcattcctcaattcttgtgccataccatggatggttagttcatactggcttttttgtttgttcatttgtcattgaaaaaaaagtcttttgttgattcaattatttttatagtgtgtttggaagcccgtttgagaaaaattaagaaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttgatttgataaatgacaaccaaattgattttgatggattttgcaggagaattagccacagaactcaccatcaaaagccatggacacattgagaaggatgagtcatgggttccagtatgtgattaattgcttctcctatagttgttcttgattcaattacattttatttattt

SEQ ID NO: 1272 - DNA, 715 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgagaattcatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtcccaaagaaaaaaaat

SEQ ID NO: 1273 - DNA, 773 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaatccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaaggatgagtcatgggttccagtatgtgattaattgcttctcctatagttgttcttgattcaattacattttatttatttggtagggtccaagaaaaagggaatctttatgcattcctgaggctgttcttgaacatggctcttttttatgtgtcatttatc

SEQ ID NO: 1274 - DNA, 777 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaatggaagctttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattccaattacattttatttatttggtagggtccaagaaaaaagggtaatcttttatgcattcctgaggctgttcttgaacatggctcttttttatgtgcattatcttagttaa

SEQ ID NO: 1275 - DNA, 752 bp, Artificial
  Glycine max FAD3B mutation created with TALEN pair GmFAD3_T01.1
  misc_feature (704): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaactggccaccacctgctccggggtcaagccgtgggcctggcacagcaccggcaacagccgctggacatggaagcttttcagatagccctttgctgaatagcctggtgggacacatcttgcattcctcaattcttgtgccataccatggatggttagttcatactggcttttttgtttgttcatttgtcattgaaaaaatcttttgttgattcaattattttatagtgtgtttggaagcccgtttgagaaaataagaaattcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttgggatttggaaccaaaattttatttgataaattgacaaccaaattgattttgatggattttgcaggagaattagccacagaactcaccatcaaaatccatggacacattgagaaggatgagtcatgggttccagtangtgattaattgcttctcctatagttgttcttgattcaattacatttta

SEQ ID NO: 1276 - DNA, 703 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattcatggaagcttttcagatagccctttgctgaatagcctggtgggacacatcttgcattcctcaattcttgtgccataccatggatggttagttcatactggcttttttgtttgttcatttgtcattgaaaaaaaagtcttttgttgattcaattatttttatagtgtgtttggaagcccgtttgagaaaaattaagaaatcgcatctggaatgtgaaaagttataactatttagcttcatttgtcgttgcaagttcttttattggttaaatttttatagcgtgctaggaaacccattcgagaaaagtaagaaattcacatctggaatgtgaaagttataactgttagcttctgagtaaacgtggaaaaatccacattttcggatttggaaccaaattttgattttgataaatggacaaccaaatttgattttggatggattttgcaggagaattagccacagaactcaccatcaaaagccatggacacattgagaaggatgagtcatgggttccagtatgtgattaattgcttctcctatagttgttcttgattcaattacattttatttatttggta

SEQ ID NO: 1277 - DNA, 761 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaatccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaaagggtaatctttatgcattcctgaggctgttcttgaacatggctctttttt

SEQ ID NO: 1278 - DNA, 776 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaagggtaatctttatgcttcctgaggtctgttcttgaacatggctcttttttatgtgtcatatcttagttaa

SEQ ID NO: 1279 - DNA, 711 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaattgtgccataccatggatggttagttcatactggcttttttgtttgttcatttgtcattgaaaaaaaatcttttgttgattcaattatttttatagtgtgtttggaagcccgtttgagaaaataagaaatcgcatctggaatgtgaaagttataactatttagcttcatttgtcgttgcaagttcttttattggttaaatttttatagcgtgctaggaaaacccattcgagaaaataagaaatcacatctggaatgtgaaagttataactgttagcttctgagtaaacgtggaaaaaaccacattttggatttggaaccaaattttatttgataaatgacaaccaaattgattttgatggattttgcaggagaattagccacagaactcaccatcaaaaaccatggacacattgagaaggatgagtcatgggttccagtatgtgattaattgcttctcctatagttgttcttgattcaattacattttatttatttggtaggtccaagaaaaaaaggggaatctttatgcttcctgaggctgttcttgaacatggctcttttttatgtgtcattatcttagtt

SEQ ID NO: 1280 - DNA, 769 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaatatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtcccaagaaaaaaatgggtaatcttttatgcttcctgaggctgttcttgaacatggctcttttttatgtgca

SEQ ID NO: 1281 - DNA, 778 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaattgaacagtaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaagggaatctttatgcattcctgaggctgttcttgaacatggctcttttttatgtgtcatttatcttag

SEQ ID NO: 1282 - DNA, 776 bp, Artificial; identical to SEQ ID NO: 1213
  Glycine max FAD3B mutation created with TALEN pair GmFAD3_T01.1

SEQ ID NO: 1283 - DNA, 782 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaatccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacatttttatttatttggtagggtccaagaaaaagggtatctttatgcattcctgaggtctgttcttgaacatggctcttttttatgtgtcatttatcttagttaa

SEQ ID NO: 1284 - DNA, 701 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaattgaaatggaagcttttcagatagccctttgctgaatagcctggtgggacacatcttgcattcctcaattcttgtgccataccatggatggttagttcatactggcttttttgtttgttcatttgtcattgaaaaaaaagtcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaaccaaattttatttgataaatgacaaccaaattgattttgatggattttgcaggagaattagccacagaactcaccatcaaaagccatggacacattgagaaggatgagtcatgggttccagtatgtgattaattgcttctcctatagttgttcttgattcaattacattttatttatttggta

SEQ ID NO: 1285 - DNA, 773 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaattgaagctttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtcccaagaaaaagggtaatctttatgcattcctgaggtctgttcttgaacatggctcttttttatgtgtcatttatctta

SEQ ID NO: 1286 - DNA, 757 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaatagccctttgctgaatagcctggtgggacacatcttgcattcctcaattcttgtgccataccatggatggttagttcatactggcttttttgtttgttcatttgtcattgaaaaaaactcttttgttgattcaattatttttatagtgtgtttggaagcccgtttgagaaaataagaaatcgcatctggaatgtgaaagttataactatttagcttcatttgtcgttgcaagttcttttattggttaaaatttttatagcgtgctaggaaaacccattcgagaaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacatttttatttatttggtaggtccaagaaaaaagggaatctttatgcttcctgaggctgttcttgaacatggctcttttttatgtgtcattatctta

SEQ ID NO: 1287 - DNA, 695 bp, Artificial
  Glycine max FAD3B mutation created with TALEN pair GmFAD3_T01.1
ctcacacattgttctgtttatgtcatttcttcttcatttggctttagacaacttaaatttgagatctttattatgttttttgcttatatggtaaagtgattcttcattatttcattcttcattgatttgacgtcaattaaatcaaaaggcttttcagatagccctttgctgaatagcctggtgggacacatcttgcattcctcaattcttgtgccataccatggatggttagttcatactggctttttttgtttgttcatttgtcattgaaaaaaaaatcttttgttgattcaattatttttatagtgtgtttggaagcccgttttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacatgaactcaccatcaaaaccatggacacattgagaaggatgagtcatgggttccagtatgtgattaattgcttctcctatagttgttcttgattcaaattaca

SEQ ID NO: 1288 - DNA, 531 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaattgtgccataccatggatggttagttcatactggcttttttgtttgttcatttgtcattgaaaaaaatcttttgttgattcaattatttttatagtgtgtttggaagcccgtttgagaaaataagaaatcgcatctggaatgtgaaaagttataactatttagcttcatttgtcgttgcaagttcttttattggttaaatttttatagcgtgctaggaaacccattcgagaaaaattaagaaatcacatctggaatgtgaaagttataactgttagcttctgagtaaacgtggaaaaaaccacattttggatttggaaccaaattttatttgataaatgacaaccaaattgattttgaggattttgcaggagaattagccacagaacttcaccatcaaaaacc

SEQ ID NO: 1289 - DNA, 655 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattggcttttcagatagccctttgctgaatagcctggtgggacacatcttgcattcctcaattcttgtgccataccatggatggttagttcatactggcttttttgtttgttcatttgtcattgaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgatt

SEQ ID NO: 1290 - DNA, 684 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaattgaagcttttcagatagccctttgctgaatagcctggtgggacacatcttgcattcctcaattcttgtgccataccatggatggttagttcatactggcttttttgtttgttcatttgtcattgaaaaaaaagtcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaaataagaaatcacatctggaatgtgaaagttataactgttagcttctgagtaaacgtggaaaaatccacattttggatttggaaccaaaattttgatttgataaatgacaaccaaagttgattttgatggattttgcaggagaattagccacagaactcaccatcaaaaagccatggacacattgagaaggatgagtcatgggttccagtatgtgattaattgcttctcctatagttgttcttgattcaattaca

SEQ ID NO: 1291 - DNA, 762 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaattgaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggtaatcttttatgcattcctgaggctgttcttgaacatggctcttttttatgtgca

SEQ ID NO: 1292 - DNA, 772 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacatttttatttatttggtagggtccaagaaaaagggaatctttatgcattcctgaggtctgttcttgaacatggctcttttttatgtgtcattatcttagttaa

SEQ ID NO: 1293 - DNA, 696 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaaatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaataagccacagaactcaccatcaaaaccatggacacattgagaaggatgagtcatgggttccagtatgtgattaattgcttctcctatagttgttcttgattcaattacattttatttatttggtagggt

SEQ ID NO: 1294 - DNA, 530 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaattgaacaggcgctgttgccggtgctgtgccaggcccacggcttgaccccggagcaggtggtggccatcgccagcaatattggtggcaagcaggcgctggagacggtgcaggcgctgttgccgtgcatggaagcttttcagatagccctttgctgaatagcctggtgggacacatcttgcattcctcaattcttgtgccataccatggatggttagttcatactggctttttgtttgttcatttgtcattgaaaaaaatctttgttgattcaattattttatagtgtgttggaagcccgtttgagaaattaagaatcgcatctggaatgtgaaagttataactatttagcttcatttgtcgttgcaagttcttttattggttaaatttttatagcgtgctagg

SEQ ID NO: 1295 - DNA, 773 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttatttgataaatgacaaccaaattgattttgatggattttgcaggagaattagccacagaactcaccatcaaaaaccatggacacattgagaaggatgagtcatgggttccagtatgtgattaattgcttctcctatagttgttcttgattcaattacattttatttatttggtaggtccaagaaaaagggaatcttttatgcttcctgaggctgttcttgaacatggctcttttttatgtgcatttatcttag

SEQ ID NO: 1296 - DNA, 772 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgatggaagcttttcagatagccctttgctgaatagcctggtgggacacatcttgcattcctcaattcttgtgccataccatggatggttagttcatactggcttttttgtttgttcatttgtcattgaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttgggtagggtcccaagaaaaagggtaatctttatgcattcctgaggtctgttcttgaacatggctcttttttatgtgtcattatcttagttaa

SEQ ID NO: 1297 - DNA, 487 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaatacccatggaagcttttcagatagccctttgctgaatagcctggtgggacacatcttgcattcctcaattcttgtgccataccatggatggttagttcatactggcttttttgtttgttcatttgtcattgaaaaaaaagtcttttgttgattcaattatttttatagtgtgttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaa

SEQ ID NO: 1298 - DNA, 664 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattggcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattaca

SEQ ID NO: 1299 - DNA, 667 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattaca

SEQ ID NO: 1300 - DNA, 758 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaaggatgagtcatgggttccagtatgtgattaattgcttctcctatagttgttcttgattcaattacattttatttatttggtagggtccaagaaaaaaagggtaatctttatgcattcctgaggctgttcttgaacatggctctttttt

SEQ ID NO: 1301 - DNA, 763 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaattgaacagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggtaaatttttatagcgtgctaggaaaacccattcgagaaaataagaaatcacatctggaatgtgaaagttataactgttagcttctgagtaaacgtggaaaaaccacattttggatttggaaccaaattttatttgataaatgacaaccaaatcgattttgatggattttgcaggagaattagccatcagaactcaccatcaaaaccatggacacattgagaaggatgagtcatgggttccagtatgtgattaattgcttctcctatagttgttcttgattcaattacattttatttaatttggtaggttccaagaaaaaaaggggaattctttatgcattcctgaggctgttcttgaacatggctctttttt

SEQ ID NO: 1302 - DNA, 776 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaatacccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaaagggaatctttatgcttcctgaggctgttcttgaacatggctcttttttatgtgcattatcttag

SEQ ID NO: 1303 - DNA, 686 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaattggaagcttttcagatagccctttgctgaatagcctggtgggacacatcttgcattcctcaattcttgtgccataccatggatggttagttcatactggcttttttgtttgttcatttgtcattgaaaaaaaagtcttttgttgattcaattatttttatagtgtgtttggaagcccgtttgagaaaaataagaaaatcgcatctggaatgtgaaaagttataactatttagcttcatttgtcgttgcaagttcttttattggttaaatttttatagcgtgctaggaaacccattcgagaaaagtaagaaattcacatctggaatgtgaaagttataactgttaagcttctgagtaaacgtggaaaaatccacattttggatttggaaccaaaattttgatttgataaatgacaaccaaattgattttgatggattttgcaggagaattagccacagaactcaccatcaaaagccatggacacattgagaaggatgagtcatgggttccagtatgtgattaattgcttctcctatagttgttcttgattcaattaca

SEQ ID NO: 1304 - DNA, 680 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaacatggaagcttttcagatagccctttgctgaatagcctggtgggacacatcttgcattcctcaattcttgtgccataccatggatggttagttcatactggcttttttgtttgttcatttgtcattgaaaaaaaagtcttttgttgattcaattatttttatagtgtgtttggaagcccgtttgagaaaaataagaaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaagccatggacacattgagaaggatgagtcatgggttccagtatgtgattaattgcttctcctatagttgttcttgattcaattaca

SEQ ID NO: 1305 - DNA, 668 bp, Artificial
  Glycine max FAD3B mutation created with TALEN pair GmFAD3_T01.1
ctcacacattgttctgttatgtcatttcttcttcatttggctttagacaacttaaatttgagatctttattatgtttcagatagccctttgctgaatagcctggtgggacacatcttgcattcctcaattcttgtgccataccatggatggttagttcatactggcttttttgtttgttcatttgtcattgaaaaaatcttttgttgattcaattatttttatagtgtgtttggaagcccgtttgagaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgattggattttgcatggagaattagcacagaactcaccatcaaaccatggaacacatgagaatggatgagtcatgggttccagtatgtgattaattgcttctcctatagttgttcttgattcattacattttatttatttggtaggtccaagaaaaaagggaatctttatgcttcctgaggctgtt

SEQ ID NO: 1306 - DNA, 768 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaattgaacagtaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtcccaagaaaaaagggtaatctttatgcattcctgaggctgttcttgaacatggctcttttttatgtg

SEQ ID NO: 1307 - DNA, 693 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgagaagcttttcagatagccctttgctgaatagcctggtgggacacatcttgcattcctcaattcttgtgccataccatggatggttagttcatactggcttttttgtttgttcatttgtcattgaaaaaaagtcttttgttgattcaattatttttatagtgtgtttggaagcccgtttgagaaaaattaagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaatccacattttggatttggaaccaaattttgatttgataaatgacaaccaaagttgattttgatggattttgcaggagaattagccacagaactcaccatcaaaagccatggacacattgagaaggatgagtcatgggttccagtatgtgattaattgcttctcctatagttgttcttgattcaattacattttatttatttggta

SEQ ID NO: 1308 - DNA, 788 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaattggcgatggccaccacctgctggggggtcaagccgtgggcctggcacagcaccggcaacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaagggaatctttatgcttcctgaggctgttcttgaacatggctcttttttatgtgtcattatcttagttaa

SEQ ID NO: 1309 - DNA, 736 bp, Artificial
  Glycine max FAD3B mutation created with TALEN pair GmFAD3_T01.1
ctcacacattgttctgttatgtcatttcttcttcatttggctttagacaacttaaatttgagatctttattatgttttttgcttatatggtaaagtgattcttcattatttcattcttcattgattgaaccatggaagcttttcagatagccctttgctgaatagcctggtgggacacatcttgcattcctcaattcttgtgccataccatggatggttagttcatactggcttttttgtttgttcatttgtcattgaaaaaaaagtcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaaagtaagaaattcacatctggaatgtgaaagttataactgttagcttctgagtaaacgtggaaaaatccacattttggatttggaaccaaattttgattttgataaaatgacaaccaaagttgattttgatggattttgcaggagaattagccacagaactcaccatcaaaagccatggacacattgagaaggatgagtcatgggttccagtatgtgattaattgcttctcctatagttgttcttgattcaattacattttatttatttggtagggtcccaagaaaaaaatgggaagtctttt

SEQ ID NO: 1310 - DNA, 787 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaatacccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaaattacattttatttatttgggtagggtccaagaaaaaagggtaatctttatgcattcctgaggtctgttcttgaacatggctcttttttatgtgtcatttatcttagttaa

SEQ ID NO: 1311 - DNA, 673 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaattgtagccgccggagtaggccttggtgtccacgatcacgccgtagtcgatgggggagcccacggtgtagatggcgccgtcgggcttcctggagcttttcagatagccctttgctgaatagcctggtgggacacatcttgcattcctcaattcttgtgccataccatggatggttagttcatactggcttttttgtttgttcatttgtcattgaaaaaaagtcttttgttgattcaattatttttatagtgtgtttggaagcccgtttgagaaataagaaatcgcatctggaatgtgaaagttataactatttagcttcatttgtcgttgcaagttcttttattggttaaatttttatagcgtgctaggaaacccattcgagaaaataagaaatcacatctggaatgtgaagttataactgttagcttctgagtaaacgtggaaaaaccacattttgggattttgggaaccaaaattttattttgataaattgacaaccaaattgattttgatgggattttgcaggagaattagccacagaactca

SEQ ID NO: 1312 - DNA, 755 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaaatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaagggtatctttatgcattcctgaggctgttcttgaacatggctctttttt

SEQ ID NO: 1313 - DNA, 694 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaatggaagctttcagatagccctttgctgaatagcctggtgggacacatcttgcattcctcaattcttgtgccataccatggatggttagttcatactggcttttttgtttgttcatttgtcattgaaaaaaaagtcttttgttgattcaattatttttatagtgtgtttggaagcccgtttgagaaaaattaagaaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaagccatggacacattgagaaggatgagtcatgggttccagtatgtgattaattgcttctcctatagttgttcttgattcaattacattttatttatttgg

SEQ ID NO: 1314 - DNA, 441 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaattgtagccgccggagtaggccttggtgtccacgatcacgccgtagtcgatgggggagcccacggtgtagatggcgccgtcgggcttcctggagcttttcagatagccctttgctgaatagcctggtgggacacatcttgcattcctcaattcttgtgccataccatggatggttagttcatactggctttttgtttgttcatttgtcattgaaaaaagtcttttgttgattcaattattttatagtgtgtttggaagcccgtttcgagaaaaagtaacgaaattcgcatctggaatgtgaaatgttataactg

SEQ ID NO: 1315 - DNA, 774 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaaaaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaagggaatctttatgcattcctgaggtctgttcttgaacatggctcttttttatgtgtcattatcttagttaa

SEQ ID NO: 1316 - DNA, 771 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaattgtggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctagggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattccaattacatttttatttatttggtagggtccaagaaaaaagggtaatctttatgcattcctgaggtctgttcttgaacatggctcttttttatgtgtca

SEQ ID NO: 1317 - DNA, 777 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtcccaagaaaaaatgggtaatctttatgcttcctgaggctgttcttgaacatggctcttttttatgtgcattatcttagttaa

SEQ ID NO: 1318 - DNA, 670 bp, Artificial
  Glycine max FAD3B mutation created with TALEN pair GmFAD3_T01.1
  misc_feature (349): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacaggcgctgttgccggtgctgtgccaggcccacggcttgaccccggagcaggtggtggccatcgccagcaatattggtggcaagcaggcgctggagacggtgcaggcgctgttgccgtgcatggaagcttttcagatagccctttgctgaatagcctggtgggacacatcttgcattcctcaattcttgtgccataccatggatggttagttcatnctggctttttgtttgttcatttgtcattgaaaaaaaatcttttgttgattcaattatttttatagtgtgtttggaagcccgtttgagaaaattaagaaatcgcatctggaatgtgaaagttataactatttagcttcatttgtcgttgcaagttcttttattggttaaatttttatagcgtgctaggaacccattcgaagaataagaaatcacatctggaatgtgaagttataactgttagcttctgagtaaacgtggaaaaacacattttggatttggaaccaaattttatttgataaatgacaaccaaattgattttga

SEQ ID NO: 1319 - DNA, 771 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaattgaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggtaatctttatgcattcctgaggctgttcttgaacatggctcttttttatgtgtcattatctta

SEQ ID NO: 1320 - DNA, 722 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtatggaagcttttcagatagccctttgctgaatagcctggtgggacacatcttgcattcctcaattcttgtgccataccatggatggttagttcatactggctttttttgtttgttcatttgtcattgaaaaaaatcttttgttgattcaattatttttatagtgtgtttggaagcccgtttgagaaaataagaaatcgcatctggaatgtgaaagttataactatttagcttcatttgtcgttgcaagttcttttattggttaaaatttttatagcgtgctaggaaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacatttttatttatttggtaggtccaagaaaaagggaatctttatgcttcctgaggctgttctgaacatggctctttttatgtgtc

SEQ ID NO: 1321 - DNA, 733 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtatggaagcttttcagatagccctttgctgaatagcctggtgggacacatcttgcattcctcaattcttgtgccataccatggatggttagttcatactggctttttttgtttgttcatttgtcattgaaaaaaattcttttgttgattcaattatttttatagtgtgtttggaagcccgtttgagaaaataagaaatcgcatctggaatgtgaaagttataactatttagcttcatttgtcgttgcaagttcttttattggttaaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacatttttattttatttgtaggtccaagaaaaagggaatctttatgcttcctgaggctgttcttgaacatggctctttttatgtgtcattatcttag

SEQ ID NO: 1322 - DNA, 693 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgatccatggaagcttttcagatagccctttgctgaatagcctggtgggacacatcttgcattcctcaattcttgtgccataccatggatggttagttcatactggcttttttgtttgttcatttgtcattgaaaaaaaagtcttttgttgattcaattatttttatagtgtgtttggaagcccgtttgagaaaaattaagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttattttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggta

SEQ ID NO: 1323 - DNA, 766 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaattgaacagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaatcgattttgatggattttgcaggagaattagccacagaactcaccatcaaaaccatggacacattgagaaggatgagtcatgggttccagtatgtgattaattgcttctcctatagttgttcttgattcaattacattttatttatttggtaggttccaagaaaaaaggggaatctttatgcattcctgaggctgttcttgaacatggctcttttttatgtgtca

SEQ ID NO: 1324 - DNA, 676 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaacctgaatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttatttgataaatgacaaccaaattgattttgatggattttgcaggagaaattagccacagaactcaccatcaaaaccatggacacattgagaaggatgagtcatgggttccagtatgtgattaattgcttctcctatagttgttcttgattc

SEQ ID NO: 1325 - DNA, 737 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaatagcctggtgggacacatcttgcattcctcaattcttgtgccataccatggatggttagttcatactggcttttttgtttgttcatttgtcattgaaaaaaatcttttgttgattcaattatttttatagtgtgtttggaagcccgtttgagaaaataagaaatcgcatctggaatgtgaaagttatactatttagcttcatttgtcgttgcaagttcttttattggttaaaatttttatagcgtgctaggaaaacccattcgagaaaaataagaaatcacatctggaatgtgaaagttataactgttagcttctgagtaaacgtggaaaaaccactttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacatttttatttatttggtaggtccaagaaaaaagggaatctttatgcttcctgaggctgttcttgaacatggctctttttatgtgtcattatctta

SEQ ID NO: 1326 - DNA, 860 bp, Artificial
  Glycine max FAD3B mutation created with TALEN pair GmFAD3_T01.1
  misc_feature (805): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacaggcgctgttgccggtgctgtgccaggcccacggcttgaccccggagcaggtggtggccatcgccagcaatattggtggcaagcaggcgctggagacggtgcaggcgctgttgccgtgcatggaagcttttcagatagccctttgctgaatagcctggtgggacacatcttgcattcctcaattcttgtgccataccatggatggttagttcatactggctttttgtttgttcatttgtcattgaaaaaaatcttttgttgattcaattattttatagtgtgtttggaagcccgtttgagaaaattaagaaatcgcatctggaatgtgaaagttataactatttagcttcatttgtcgtgcaagttcttttattggttaaatttttatagcgtgctaggaaacccattcgaagaaataagaaatcacatctggaatgtgaaagttataactgttagcttctgagtaaacgtggaaaaaccacattttggatttggaaccaaattttatttgataaatgacaaccaaattgattttgatggattttgcaaggagaatttagccacagaatctcaccatcaaaaccatggacacattgagaaggatgagtcatgggttccagtatgtgattaattgcttctcctatagttgttcttgattcaattacattttntttatttggtaggtccaaagaaaaaagggaatctttatgcttcctgaggctgttc

SEQ ID NO: 1327 - DNA, 754 bp, Artificial
  Glycine max FAD3B mutation created with TALEN pair GmFAD3_T01.1
  misc_feature (153); (221); (234): n is a or c or t or g
ctcacacattgttctgttatgtcatttcttcttcatttggctttagacaacttaaattttgagatctttattatgtttttgcttatatggtaaagtgattcttcattatttcattcttcattgattgaattgaacagtaaaagtttttttccngaaaaggccccctttttggaaaataagccccttgggtgggggaaccacattcttttggcaatttcccnaaattttcttggngcccataccatggatggttagttcatactggctttttttgtttgttcatttgtcattgaaaaaaaaagtcttttgttgattcaattatttttatagtgtgtttggaagcccgtttgagaaaaattaagaaatcgcatctggaatgtgaaagttataactatttagcttcatttgtcgttgcaagttctttttattggttaaaattttttatagcgtgctaggaaaaccccatttcgagaaaaagtaagaaattcacatctggaatgtgaaaagtttataactgtttagcttctgagtaaacgtggaaaaaatccacatttttggattttgggaaacccaaaatttttgattttgataaaattgacaaaccaaaagtttgatttttggattgggatttttcgcagggagaaatttagcccacatgaaactcaacccatccaaaaagccaatgggacacatttgagaaagggatgagtcatgggtttccagtatgtgattaattgcttctcctatagttgtt

SEQ ID NO: 1328 - DNA, 489 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaatccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaataagaaatcgcatctggaatgtgaaagttataactatttagcttcatttgtcgttgcaagttcttttattggttaaatttttatagcgtgctaggaaacccattcgagaaaataagaaatcatcatctggaatgtgaaagttataactgttagcttctgagtaaacgtgg

SEQ ID NO: 1329 - DNA, 775 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaattgaacagtaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacatttttatttatttgggtagggtcccaagaaaaaaagggtaatctttatgcattcctgaggtctgttcttgaacatggctcttttttatgtgtca

SEQ ID NO: 1330 - DNA, 710 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaacatggaagcttttcagatagccctttgctgaatagcctggtgggacacatcttgcattcctcaattcttgtgccataccatggatggttagttcatactggcttttttgtttgttcatttgtcattgaaaaaaaagtcttttgttgattcaattatttttatagtgtgtttggaagcccgtttgagaaaaataagaaaatcgcatctggaatgtgaaaagttataactatttagcttcatttgtcgttgcaagttcttttattggttaaatttttatagcgtgctaggaaaacccattcgagaaaaagtaagaaattcacatctggaatgtgaaagttataactgttagcttctgagtaaacgtggaaaaatccacattttggatttggaaccaaaattttgattttgataaatgacaaccaaagttgattttgatggattttgcaggagaattagccacagaactcaccatcaaaagccatggacacattgagaaggatgagtcatgggttccagtatgtgattaattgcttctcctatagttgttcttgattcaattacattttatttatttggtagggt

SEQ ID NO: 1331 - DNA, 771 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaatacccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaaagaaaaaagggtaatctttatgcttcctgaggctgttcttgaacatggctcttttttatgtgtca

SEQ ID NO: 1332 - DNA, 770 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgatacatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaaccatggacacattgagaaggatgagtcatgggttccagtatgtgattaattgcttctcctatagttgttcttgattcaattacattttatttatttggtaggtccaagaaaaaagggaatctttatgcttcctgaggctgttcttgaacatggctcttttttatgtgtcatatcttag

SEQ ID NO: 1333 - DNA, 684 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaattgaacagtaagcttttcagatagccctttgctgaatagcctggtgggacacatcttgcattcctcaattcttgtgccataccatggatggttagttcatactggcttttttgtttgttcatttgtcattgaaaaaaaagtcttttgttgattcaattatttttatagtgtgtttggaagcccgtttgagaaaaattaagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaagccatggacacattgagaaggatgagtcatgggttccagtatgtgattaattgcttctcctatagttgttcttgattcaattaca

SEQ ID NO: 1334 - DNA, 787 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaattgaacagtaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttattttggtagggtccaagaaaaaaagggtaatcttttatgcattcctgaggctgttcttgaacatggctcttttttatgtgtcatttatcttagttaa

SEQ ID NO: 1335 - DNA, 701 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaaccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaaatttttatagcgtgctaggaaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacatgaactcaccatcaaaaccatggacacattgagaaggatgagtcatgggttccagtatgtgattaattgcttctcctatagttgttcttgattcaattacatttttatttatttggtaggg

SEQ ID NO: 1336 - DNA, 641 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaattgtgcattcctcaattcttgtgccataccatggatggttagttcatactggcttttttgtttgttcatttgtcattgaaaaaatcttttgttgattcaattatttttatagtgtgtttggaagcccgtttgagaaataagaaatcgcatctggaatgtgaaagttataactatttagcttcatttgtcgttgcaaagttcttttattggttaaatttttatagcgtgctaggaaacccattcgagaaaataagaaatcacatctggaatgtgaaagttataactgttagcttctgagtaaacgtggaaaaaaccacattttggatttggaaccaaatttatttgataatgacaaccaaattgattttgatggattttgcaggagaattatgccacagaactcacatacaaaccatggacacattgagaaggattgagtcatgggttccagtatgtgattaattgcttctcctatagttgttcttgattcaattacattttatttatttggta

SEQ ID NO: 1337 - DNA, 497 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcatatggaagcttttcagatagccctttgctgaatagcctggtgggacacatcttgcattcctcaattcttgtgccataccatggatggttagttcatactggcttttttgtttgttcatttgtcattgaaaaaaaagtcttttgttgattcaattatttttatagtgtgtttggaagcccgtttgagaaaaataagaaatcgcatctggaatgtgaaagttataactatttagcttcatttgtcgttgcaagttcttttattggttaaatttttcatagcgtgctaggaaacccattcgagaaaagtaagaaattcacatctggaatgtgaaagttataactgttagcttctgagtaaacgtggaaaaatccacatttt

SEQ ID NO: 1338 - DNA, 686 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaattggaagcttttcagatagccctttgctgaatagcctggtgggacacatcttgcattcctcaattcttgtgccataccatggatggttagttcatactggcttttttgtttgttcatttgtcattgaaaaaaaagtcttttgttgattcaattatttttatagtgtgtttggaagcccgtttgagaaaaattaagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttattt

SEQ ID NO: 1339 - DNA, 714 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaattgaacagtaagcttttcagatagccctttgctgaatagcctggtgggacacatcttgcattcctcaattcttgtgccataccatggatggttagttcatactggcttttttgtttgttcatttgtcattgaaaaaaaagtcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaaa

SEQ ID NO: 1340 - DNA, 795 bp, Artificial
  Glycine max FAD3B mutation created with TALEN pair GmFAD3_T01.1
  misc_feature (303): n is a or c or t or g
ctcacacattgttctgttatgtcatttcttcttcatttggctttagacaacttaaatttgagatctttattatgtttttgcttatatggtaaagtgattcttcattatttcattcttcattgattgaattggaccatggaggccttttcgaagattagccctttgccttgaatagacctggctgggatcgacatcttgcattccttccaattcattgttgccataccatggatggttagttcatactggcttttttgtttgttcatttgtcattgaaaaaaaaatcttttgttgattcaattnttttttatagtgtgtttggaagcccgtttgagaaaaataagaaatcgcatctggaatgtgaaagttataactatttagcttcatttgtcgttgcaagttcttttattggttaaaattttttatagcgtgctaggaaacccattcgagaaaataagaaatcacatctggaatgtgaaagttataactgttagcttctgagtaaacgtggaaaaaccacattttggatttggaaccaaattttattttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggaatctttatgcttcctgaggctgttcttgaacatggctcttttttatgtgtcattatctta

SEQ ID NO: 1341 - DNA, 700 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattggcttttcagatagccctttgctgaatagcctggtgggacacatcttgcattcctcaattcttgtgccataccatggatggttagttcatactggcttttttgtttgttcatttgtcattgaaaaaaaagtcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttgatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaatggg

SEQ ID NO: 1342 - DNA, 722 bp, Artificial
  Glycine max FAD3B mutation created with TALEN pair GmFAD3_T01.1
ctcacacattgttctgttatgtcatttcttcttcatttggctttagacaacttaaatttgagatctttattactttgtttgcttatatggtaaagtgattcttcattatttcattcttcattgattgaacatggaagcttttcagatagccctttgctgaatagcctggtggggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaaatttttatagcgtgctaggaaacccattcgagaaaataagaaatcacatctggaatgtgaaagttataactgttagcttctgagtaaacgtggaaaaaccacattttggatttggaaccaaaattttgatttgataaatgacaaccaaattgattttgatggattttgcaggagaattagccacagaactcaccatcaaaagccatggacacattgagaaggatgagtcatgggttccagtatgtgattaattgcttctcctatagttgttcttgattcaattacattttatttatttggtagggtccaagaaaaatgggaatc

SEQ ID NO: 1343 - DNA, 711 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgatggaagcttttcagatagccctttgctgaatagcctggtgggacacatcttgcattcctcaattcttgtgccataccatggatggttagttcatactggcttttttgtttgttcatttgtcattgaaaaaaaagtcttttgttgattcaattatttttatagtgtgtttggaagcccgtttgagaaaaattaagaaatcgcatctggaatgtgaaaagttataactatttagcttcatttgtcgttgcaagttcttttattggttaaatttttatagcgtgctaggaaacccattcgagaaaagtaagaaatcacatctggaatgtgaaagttataactgttagcttctgagtaaacgtggaaaaatccacattttggatttggaaccaaaattttgatttgataaatgacaaccaaattgattttgatggattttgcaggagaattagccacagaactcaccatcaaaagccatggacacattgagaaggatgagtcatgggttccagtatgtgattaattgcttctcctatagttgttcttgattcaattacattttatttatttggtaggtccaagaaaaatggg

SEQ ID NO: 1344 - DNA, 676 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattaca

SEQ ID NO: 1345 - DNA, 691 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggt

SEQ ID NO: 1346 - DNA, 765 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattcatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttatttgataaatgacaaccaaattgattttgatggattttgcaggagaaattagccacagaactcaccatcaaaaccatggacacattgagaaggatgagtcatgggttccagtatgtgattaattgcttctcctatagttgttcttgattcaattacattttatttatttggtagggtccaagaaaaagggtaatctttatgcattcctgaggtctgttcttgaacatggctcttttttatgtgtca

SEQ ID NO: 1347 - DNA, 662 bp, Artificial
  Glycine max FAD3B mutation created with TALEN pair GmFAD3_T01.1
ctcacacattgttctgttatgtcatttcttcttcatttggctttagacaacttaaatttgagatctttattatgtttcagatagccctttgctgaatagcctggtgggacacatcttgcattcctcaattcttgtgccataccatggatggttagttcatactggcttttttgtttgttcatttgtcattgaaaaaaattcttttgttgattcaattatttttatagtgtgtttggaagcccgtttgagaaaataagaaatcgcatctggaatgtgaaagttataactatttagcttcatttgtcgttgcaagttcttttattggttaaaatttttatagcgtgctaggaaacccattcgagaaaataagaaatcacatctggaatgtgaaagttataactgttagcttctgagtaaacgtggaaaaaaccacattttggatttggaaccaaattttatttgataaattgacaaccaaattgattttgattggattttgcatggagaattagcaacagaactcaccatcaaaccatgaacacatgagaggatgagtcatgggttccagtatgtgattaattgcttctcctatagttgttcttgattcaattacattttatttatttggtaggtccaagaaaaaagggaatctttatgcttcc

SEQ ID NO: 1348 - DNA, 727 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaattgaacagtaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaaacccattcgagaaaaataagaaatcacatctggaatgtgaaagttataactgttagcttctgagtaaacgtggaaaaaaccacattttggatttggaaccaaaattttatttgataaatgacaaccaaattgattttgatggattttgcaggagaattagccacagaactcaccatcaaaaccatggacacattgagaaaggatgagtcatgggttccagtatgtgattaattgcttctcctatagttgttcttgattcaattacatttttatttatttggtagggtcccaaagaaaaaaagggtaa

SEQ ID NO: 1349 - DNA, 475 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaatatggaagcttttcagatagccctttgctgaatagcctggtgggacacatcttgcattcctcaattcttgtgccataccatggatggttagttcatactggcttttttgtttgttcatttgtcattgaaaaaaaagtcttttgttgattcaattatttttatagtgtgtttggaagcccgtttgagaaaaattaagaaaatcgcatctggaatgtgaaaagttataactatttagcttcatttgtcgttgcaagttcttttattggttaaatttttatagcgtgctaggaaacccattcgagaaaaagtaagaaattcacatctggaatgtgaaagttataactgtt

SEQ ID NO: 1350 - DNA, 446 bp, Artificial
  Glycine max FAD3B mutation created with TALEN pair GmFAD3_T01.1
ctcacacattgttctgttatgtcatttcttcttcatttggctttagacaacttaaatttgagatctttattatgtttcagatagccctttgctgaatagcctggtgggacacatcttgcattcctcaattcttgtgccataccatggatggttagttcatactggcttttttgtttgttcatttgtcattgaaaaaaatcttttgttgattcaattatttttatagtgtgtttggaagcccgtttgagaaataagaaatcgcatctggaatgtgaaagttataactatttagcttcatttgtcgttgcaagttcttttattggttaaaatttttatagcgtgctaggaaacccattcgagaaaataagaaatcacatctggaatgtgaaagttataactgttagcttctgagtaaacgtggaaaaaaccacattttggatttggaa

SEQ ID NO: 1351 - DNA, 787 bp, Artificial
  Glycine max FAD3B mutation created with TALEN pair GmFAD3_T01.1
  misc_feature (292): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaagggaatctttatgcttcctgaggctgttcttgaacatggctcttttttatgtgtcattatcttagttaa

SEQ ID NO: 1352 - DNA, 779 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaattgaaaagcttttcagatagccctttgctgaatagcctggtgggacacatcttgcattcctcaattcttgtgccataccatggatggttagttcatactggcttttttgtttgttcatttgtcattgaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttatttgataaatgacaaccaaattgattttgatggattttgcaggagaattagccacagaactcaccatcaaaaaccatggacacattgagaaggatgagtcatgggttccagtatgtgattaattgcttctcctatagttgttcttgattcaaattacatttttatttatttggtaggtccaagaaaaagggaatctttatgcttcctgaggctgttcttgaacatggctcttttttatgtgtcatttatcttagttaa

SEQ ID NO: 1353 - DNA, 784 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattcatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacatttttattttattttgggtagggtcccaagaaaaaaagggtaatcttttatgcattcctgaggtctgttcttgaacatggctcttttttatgtgtcattatcttagttaa

SEQ ID NO: 1354 - DNA, 784 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaattgaccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaagggtatctttatgcattcctgaggtctgttcttgaacatggctcttttttatgtgtcatttatcttagttaa

SEQ ID NO: 1355 - DNA, 667 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgatt

SEQ ID NO: 1356 - DNA, 781 bp, Artificial
  Glycine max FAD3B mutation created with TALEN pair GmFAD3_T01.1
ctcacacattgttctgttatgtcatttcttcttcatttggctttagacaacttaaatttgagattctttattattgttttgcttatatggtaaagtgattcttcattatttcattcttcattgattgaccatggaagcttttcagatagccctttgctgaatagcctggtggggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtcccaagaaaaaggaggatctttatgcttcctgaggtctgttcttgaacatggctcttttttatgtgtcattatcttagttaa

SEQ ID NO: 1357 - DNA, 774 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaattgaacatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttgggtagggtcccaagaaaaaagggtaatctttatgcattcctgaggtctgttcttgaacatggctcttttttatgtgtca

SEQ ID NO: 1358 - DNA, 650 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaattgaaaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacatgaactcaccatcaaaaccatggacacattgagaaggatgagtcatgggttccagtatgtgattaattgcttc

SEQ ID NO: 1359 - DNA, 698 bp, Artificial
  Glycine max FAD3B mutation created with TALEN pair GmFAD3_T01.1
ctcacacattgttctgttatgtcatttcttcttcattgattgaattgaaccatggaagcttttcagatagcccctttgctgaatagcctggtgggacacatcttgcattcctcaattcttgtgccataccatggatggttagttcatactggcttttttgtttgttcatttgtcattgaaaaaaatcttttgttgattcaattatttttatagtgtgtttggaagcccgtttgagaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaaaaggggaatctttatgcttcctgaggctgttcttgaacatggctcttttttatgtgtcattatcttagtt

SEQ ID NO: 1360 - DNA, 782 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaaccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttgggtagggtcccaagaaaaaagggtaatctttatgcattcctgaggctgttcttgaacatggctcttttttatgtgtcattatcttagttaa

SEQ ID NO: 1361 - DNA, 643 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtatggaagcttttcagatagccctttgctgaatagcctggtgggacacatcttgcattcctcaatcttgtgccataccatggatggttagttcatactggcttttttgtttgttcatttgtcattgaaaaaaaatcttttagttgattcaattattttatatgtgtgttggaagccgttgagaaaataagaaatcgcatctggaatgtgaaagttataactatttagcttcatttgtcgttgcaagttcttttattggttaaaatttttatagcgtgctaggaaaacccattcgagaaaaataagaaatcacatctggaatgtgaaaagttataactgttagcttctgagtaaaacgtggaaaaaaccacatttttggatttggaaccaaaattttatttgataaaatgacaaccaaaaattgattttgatggattttgcaggaagaaattagccacagaaactcaccatcaaaaaccatggacacattgagaaggatgagtcatgggttccagtaatgtgattaattgcttctcctatagttgttcttgattc

SEQ ID NO: 1362 - DNA, 680 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaattgcatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattaca

SEQ ID NO: 1363 - DNA, 500 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaatccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttaagcttctgagtaaacgtggaaaaaccaca

SEQ ID NO: 1364 - DNA, 797 bp, Artificial
  Glycine max FAD3B mutation created with TALEN pair GmFAD3_T01.1
ctcacacattgttctgttatgtcatttcttcttcatttggctttagacaacttaaatttgagatctttattatgttttttgcttatatggtaaagtgattcttcattatttcattcttcattgattgaacatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattattttttatagtgtgtttggaagcccgtttgagaaaaataagaaatcgcatctggaatgtgaaagttataactatttagcttcatttgtcgttgcaagttcttttattggttaaaattttttatagcgtgctaggaaacccattcgagaaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattccaattacatttttattttattttgggtaggggtccccaaagaaaaaaaaggggaatcttttatgcttcctgaggcttgtttcttgaacatggctcttttttatgtgtcattatcttagttaa

SEQ ID NO: 1365 - DNA, 680 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaatacccatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgcttaggaaaacccattcgagaaaataagaaatcacatctggaatgtgaaagttataactgttagcttctgagtaaacgtggaaaaaccacattttggatttggaaccaaaattttatttgataaatgacaaccaaattgattttgatggattttgcaggagaattagccacatgaactcaccatcaaaaccatggacacattgagaaaggatgagtcatgggttccagtatgtgattaattgcttctcctatagttgttcttgattc

SEQ ID NO: 1366 - DNA, 659 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaattggaagctttcagatagcccttttgctgaattagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttg

SEQ ID NO: 1367 - DNA, 767 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaacatggaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaaagggaatcttttatgcttcctgaggctgttcttgaacatgggctctttttttatgtgtca

SEQ ID NO: 1368 - DNA, 597 bp, Artificial
  Glycine max FAD3B mutation created with TALEN pair GmFAD3_T01.1
  misc_feature (350): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacaggcgctgttgccggtgctgtgccaggcccacggcttgaccccggagcaggtggtggccatcgccagcaatattggtggcaagcaggcgctggagacggtgcaggcgctgttgccgtgcatggaagcttttcagatagccctttgctgaaatagcctggtgggacacatcttgcattcctcaattcttgtgccataccatggatggttagttcatnctggctttttgtttgttcatttgtcatgaaaaaaactcttttgttgattcaattatttttataggtgtttggaagcccgtttgagaaaattaagaatcgcatctggaatgtgaaagttataactatttagcttcatttgtcgttgcaagttcttttattggttaaatttttatagcgtgctaggaacccattcgaagaataagaaatcacatctggaatgtgaaagttataactgttagcttctgag

SEQ ID NO: 1369 - DNA, 767 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaattgaaaagcttttcagatagcccttttgctgaatagcctggtgggacacatcttgcattcctcaattcttgtgccataccatggatggttagttcatactggctttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttgatttatttggtaggtccaaagaaaaaagggaatctttatgcttcctgaggctgttcttgaacatggctctttttttatgtg

SEQ ID NO: 1370 - DNA, 782 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaatggaagcttttcagatagccctttgctgaatagcctggtgggacacatcttgcattcctcaattcttgtgccataccatggatggttagttcatactggcttttttgtttgttcatttgtcattgaaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaaccacattttggatttggaaccaaaattttatttgataaatgacaaccaaattgattttgatggattttgcaggagaattagccacagaactcaccatcaaaaccatggacacattgagaaaggatgagtcatgggttccagtatgtgattaattgcttctcctatagttgttcttgattcaattacattttatttatttggtagggtccaagaaaaaagggaatctttatgcattcctgaggctgttcttgaacatggctcttttttatgtgtcatttatcttagttaa

SEQ ID NO: 1371 - DNA, 785 bp, Artificial
  Glycine max FAD3B mutation created with TALEN pair GmFAD3_T01.1
ctcacacattgttctgttatgtcatttcttcttcatttggctttagacaacttaaatttgagatctttattatgtttttgcttatatggtaaagtgattcttcattatttcattcttcattgattgaattgaacagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaaatttttatagcgtgctaggaaaacccattcgagaaaaataagaaatcacatctggaatgtgaaagttataactgttagcttctgagtaaacgtggaaaaaccacattttggatttggaaccaaaattttatttgataaatgacaaccaaatcgattttgatggattttgcaggagaattagccacagaactcaccatcaaaaccatggacacattgagaaggatgagtcatgggttccagtatgtgattaattgcttctcctatagttgttcttgattcaattacattttatttatttggtaggttccaagaaaaaaggggaatctttatgcattcctgaggctgttcttgaacatggctcttttttatgtgtcatttatcttagttaa

SEQ ID NO: 1372 - DNA, 677 bp, Artificial
  Glycine max FAD3B mutation created with TALEN pair GmFAD3_T01.1
ctcacacattgttctgttatgtcatttcttcttcatttggctttagacaacttaaatttgagatctttattatgttttttgcttatatggtaaagtgattcttcattatttcattcttcattgattgaattgaacagtaagcttttcagatagccctttgctgaatagcctggtgggacacatcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttatttgataaatgacaaccaaattgattttgatggattttgcaggagaattagccacagaactcaccatcaaaaaccatggacacattgagaaaggatgagtcatgggttccagtatgtgattaattgcttctcctatagttgttcttgatt

SEQ ID NO: 1373 - DNA, 598 bp, Artificial
  Glycine max FAD3A mutation created with TALEN pair GmFAD3_T02.1
cactgctttgttatgcctacctcatttcatttggctttagacaacttaaatttgagatctttattatgtttttgcttatatggtaaagtgattcattcttcacattgaattgaacagtggccatggaagcttttcagacagcccttttctaaatagcctggtgggacagcattcctcaattcttgtgccataccatggatggttagttcatcccggctttttgtttgtcattggaagttcttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgatgaaaataagaaatcacgtttaaaatgtgaaagttataactattaacttttgactaaacttgaaaaaatcacattttgatgtggaaccaaatctgatttgagaaccaagttgattttgatggatttgcaggagaattagccacagaactcaccatcaaaatcatggacacattgagaaggatgaatcctgggttccagtatgt

SEQ ID NO: 1374 - DNA, 715 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggatttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacatttttttgtca

SEQ ID NO: 1375 - DNA, 711 bp, Artificial
  Glycine max FAD3A mutation created with TALEN pair GmFAD3_T02.1
cactgctttgttatgcctacctcatttcatttggctttagacaacttaaatttgagatctttattatgtttttgcttatatggtaaagtgattcattcttcacattgaattgaacagtggccatggaagcttttcagacagcccttttctaaatagcctggtgggacactcaattcttgtgccataccatggatggttagttcatcccggctttttgtttgtcattggaagttcttttattgattcaatttttatagcgtgttcggaaacgcgtttcagaaaataatgaaatacatcttgaatctgaaagttataacttttagtcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaattatttatttaataagttcaagaaaaaggaatctttatacttcagataaagctgttcttgaacatttttttgtcatatc

SEQ ID NO: 1376 - DNA, 728 bp, Artificial
  Glycine max FAD3A mutation created with TALEN pair GmFAD3_T02.1
cactgctttgttatgcctacctcatttcatttggctttagacaacttaaatttgagatctttattatgtttttgcttatatggtaaagtgattcattcttcacattgaattgaacagtggccatggaagcttttcagacagcccttttctaaatagcctggtgggacgcattcctcaattcttgtgccataccatggatggttagttcatcccggctttttgtttgtcattggaagttcttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggatttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacatttttttgtcattatctagttaaccg

SEQ ID NO: 1377 - DNA, 715 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacagcattcctcaattcttgtgccataccatggatggttagttcatcccggcttttttgtttgtcattggaagttctttttattgattcaatttttatagcgtgttcggaaacgcgtttcagaaaataatgaaaatacatctgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacatttttttt

SEQ ID NO: 1378 - DNA, 730 bp, Artificial
  Glycine max FAD3A mutation created with TALEN pair GmFAD3_T02.1
  misc_feature (677): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgttgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttntacttcagataaagctgttcttgaacatttttttgtcattatctagttaaccg

SEQ ID NO: 1379 - DNA, 706 bp, Artificial
  Glycine max FAD3A mutation created with TALEN pair GmFAD3_T02.1
cactgctttgttatgcctacctcatttcatttggctttagacaacttaaatttgagatctttattatgtttttgcttatatggtaaagtgattcattcttcacattgaattgaacagtggccatggaagcttttcagacagcccttttctaaatagcctggtagcattcctcaattcttgtgccataccatggatggttagttcatcccggctttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggatttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacatttttttt

SEQ ID NO: 1380 - DNA, 725 bp, Artificial
  Glycine max FAD3A mutation created with TALEN pair GmFAD3_T02.1
cactgctttgttatgcctacctcatttcatttggctttagacaacttaaatttgagatctttattatgtttttgcttatatggtaaagtgattcattcttcacattgaattgaacagtggccatggaagcttttcagacagcccttttctaaatagcctggtgggacagcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttcgtcattatct

SEQ ID NO: 1381 - DNA, 732 bp, Artificial
  Glycine max FAD3A mutation created with TALEN pair GmFAD3_T02.1
  misc_feature (678): n is a or c or t or g
cactgctttgttatgcctacctcatttcatttggctttagacaacttaaatttgagatctttattatgtttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggatttgcaggagaattagccacagaactcaccatcaaaatcatggacacattgagaaggatgaatcctgggttccagtatgtgattaactacttcctctatagttatttttgattcaattaaatttatttatttaataagttcaagaaaatggaatctttntacttcagataaagctgttcttgaacatttttttcgtcattatctagttaaccg

SEQ ID NO: 1382 - DNA, 550 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatgcttgcattcctcaattcttgtgccataccatggatggttagttcatcccggctttttgtttgtcattggaagttcttttattgattcaatttttatagcgtgttcggaaacgcgtttcagaaaataatgaaatacatcttgaatctgaaagttataacttttagcttcattgtcattgaaaagttcttttattaattatatttttaattgcgtgtttggaatcccatttgagaaaataagaaatcacgtttaaaatgtgaaagttataactattaactttgactaaacttgaaaaaatcacattttgatgtggaaccaaatctgatttgagaaccaagttgattttgatggattttgcaggagaattagccacagaatctcaccatcaaaaatcatggacacattgagaaggatgaatcctggg

SEQ ID NO: 1383 - DNA, 730 bp, Artificial
  Glycine max FAD3A mutation created with TALEN pair GmFAD3_T02.1
cactgctttgttatgcctacctcatttcatttggctttagacaacttaaatttgagatctttattatgtttttgcttatatggtaaagtgattcattcttcacattgaattgaacagtggccatggaagcttttcagacagcccttttctaaatagcctggtagcattcctcaattcttgtgccataccatggatggttagttcatcccggctttttgtttgtcattggaagttctttttattgaattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaataggaatctttatacttcagataaagctgttcttgaacatttttttgtcattatctaagttaacc

SEQ ID NO: 1384 - DNA, 732 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagcttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacattttttttgtcattatcttagttaaccg

SEQ ID NO: 1385 - DNA, 735 bp, Artificial
  Glycine max FAD3A mutation created with TALEN pair GmFAD3_T02.1
  misc_feature (682): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttntacttcagataaagctgttcttgaacatttttttgtcattatctagttaaccg

SEQ ID NO: 1386 - DNA, 465 bp, Artificial
  Glycine max FAD3A mutation created with TALEN pair GmFAD3_T02.1
cactgctttgttatgcctacctcatttcatttgctttatgatcaacttaaatttgagatctttattatgtttttgcttattatggtaagtagattcattcttcacattgaattgaacagtggccatggaagcttttcagacagcccttttctaaatagcctggtgggacacatcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccattgagaaataagaaatcacgtttaaaatgtgaaagttataactattaacttttgactaaacttgaaaaa

SEQ ID NO: 1387 - DNA, 730 bp, Artificial
  Glycine max FAD3A mutation created with TALEN pair GmFAD3_T02.1
  misc_feature (675): n is a or c or t or g
cactgctttgttatgcctacctcatttcatttggctttagacaacttaaatttgagatctttattatgtttttgcttatatggtaaagtgattcattcttcacattgaattgaacagtggccatggaagcttttcagacagcccttttctaaatagcctggtgggacgcattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaatttatttatttaataagttcaagaaaatggaatctttntacttcagataaagctgttcttgaacattttttttcgtcattatctagttaaccg

SEQ ID NO: 1388 - DNA, 719 bp, Artificial
  Glycine max FAD3A mutation created with TALEN pair GmFAD3_T02.1
cactgctttgttatgcctacctcatttcatttggctttagacaacttaaatttgagatctttattatgtttttgcttatatggtaaagtgattcattcttcacattgaattgaacagtggccatggaagcttttcagacagcccttttctaaatagcctggtgggacactgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaattatttatttaataagttcaagaaaaaggaatctttatacttcagataaagctgttcttgaacatttttttcgtca

SEQ ID NO: 1389 - DNA, 696 bp, Artificial
  Glycine max FAD3A mutation created with TALEN pair GmFAD3_T02.1
  misc_feature (614): n is a or c or t or g
cactgctttgttatgcctacctcatttcatttggctttagacaacttaaatttgagatctttattatgtttttgcttatatggtaaagtgattcattcttcacattgaattgaacagtggccatggaagcttttcagacagcccttttctaaatagcctggtgggacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatgtattttgcaggagaattagccacagaactcaccatcaaaatcatggacacattgagaaggatgaatcctgggttccagtatgtgattaactacttcctcnatagttatttttgattcaattaaatttatttatttaataagttcaagaaaaaggaatctttatacttcagataaagctgttc

SEQ ID NO: 1390 - DNA, 735 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacactgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggatttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacatttttttgtcattatctagttaaccga

SEQ ID NO: 1391 - DNA, 454 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacttgtgccataccatggatggttatgttcatcccggctttttgtttgtcattggaagttcttttattgattcaattttatagtcgtgttcggaaacgcgtttcagaaaataatgaaatacatcttgaatctgaaaagttataacttttagcttctattgtcattgaaaagtttcttttattaattatattttattgcgtgtttggaatcccatttgagaaattaagaaatcacgtttaaaatgtgaaagttataactattaacttttgaactaaactgtaaaaaa

SEQ ID NO: 1392 - DNA, 731 bp, Artificial
  Glycine max FAD3A mutation created with TALEN pair GmFAD3_T02.1
cactgctttgttatgcctacctcatttcatttggctttagacaacttaaatttgagatctttattatgtttttgcttatatggtaaagtgattcattcttcacattgaattgaacagtggccatggaagcttttcagacagcccttttctaaatagcctggtgggacacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacatttttttcgtcattatctagttaaccg

SEQ ID NO: 1393 - DNA, 732 bp, Artificial
  Glycine max FAD3A mutation created with TALEN pair GmFAD3_T02.1
  misc_feature (678): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataattattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttntacttcagataaagctgttcttgaacatttttttcgtcattatctagttaaccg

SEQ ID NO: 1394 - DNA, 730 bp, Artificial
  Glycine max FAD3A mutation created with TALEN pair GmFAD3_T02.1
cactgctttgttatgcctacctcatttcatttggctttagacaacttaaatttgagatctttattatgtttttgcttatatggtaaagtgattcattcttcacattgaattgaacagtggccatggaagcttttcagacagcccttttctaaatagcctggtgggacattcctcaattcttgtgccataccatggatggttagttcatcccggctttttgtttgtcattggaagttctttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacatttttttcgtcattatcttagttaaccg

SEQ ID NO: 1395 - DNA, 604 bp, Artificial
  Glycine max FAD3A mutation created with TALEN pair GmFAD3_T02.1
cactgctttgttatgcctacctcatttcatttggctttagacaacttaaatttgagatctttattatgtttttgcttatatggtaaagtgattcattcttcacattgaattgaacagtggccatggaagcttttcagacagcccttttctaaatagcctggtgggacagcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgatt

SEQ ID NO: 1396 - DNA, 721 bp, Artificial
  Glycine max FAD3A mutation created with TALEN pair GmFAD3_T02.1
cactgctttgttatgcctacctcatttcatttggctttagacaacttaaatttgagatctttattatgtttttgcttatatggtaaagtgattcattcttcacattgaattgaacagtggccatggaagcttttcagacagcccttttctaaatagcctggtgggacacttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgatttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaaggaatcttatacttcagataaagctgattcttgaacatttttttgtcattatcttagttaaccgag

SEQ ID NO: 1397 - DNA, 730 bp, Artificial
  Glycine max FAD3A mutation created with TALEN pair GmFAD3_T02.1
cactgctttgttatgcctacctcatttcatttggctttagacaacttaaatttgagatctttattatgtttttgcttatatggtaaagtgattcattcttcacattgaattgaacagtggccatggaagcttttcagacagcccttttctaaatagcctggtgggacacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggatttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacatttttttgtcattatctagttaaccg

SEQ ID NO: 1398 - DNA, 712 bp, Artificial
  Glycine max FAD3A mutation created with TALEN pair GmFAD3_T02.1
  misc_feature (668): n is a or c or t or g
cactgctttgttatgcctacctcatttcatttggctttagacaacttaaatttgagatctttattatgtttttgcttatatggtaaagtgattcattcttcacattgaattgaacagtggccatggaagcttttcagacagcccttttctaaatagcctggtgggacactcaattcttgtgccataccatggatggttagttcatcccggcttttttgtttgtcattggaagttctttttattgattcaatttttatagcgtgttcggaaacgcgtttcagaaaataatgaaatacatcttgaatctgaaagttataacttttagtcttcattgtcattgaaagttcttttattaattatattttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttattataagtcaagaaaaaggaatcttntcttcagataaagctgttcttgaacattttttttcgtcattatc

SEQ ID NO: 1399 - DNA, 710 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtggggcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaataagaaatcacgtttaaaatgtgaaagttataactattaacttttgactaaacttgaaaaaattcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaagggaatctttatacttcagataaagctgttcttgaacatttttt

SEQ ID NO: 1400 - DNA, 725 bp, Artificial
  Glycine max FAD3A mutation created with TALEN pair GmFAD3_T02.1
  misc_feature (671): n is a or c or t or g
cactgctttgttatgcctacctcatttcatttggctttagacaacttaaatttgagatctttattatgtttttgcttatatggtaaagtgattcattcttcacattgaattgaacagtggccatggaagcttttcagacagcccttttctaaatagcctggtgggacactcaattcttgtgccataccatggatggttagttcatcccggctttttgtttgtcattggaagttcttttattgattcaatttttatagcgtgttcggaaacgcgtttcagaaaataatgaaatacatcttgaatctgaaagttataaacttttagtcttcattgtcattgaaagttacttttattaattatattttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttntacttcagataaagctgttcttgaacattttttttgtcattatctagttaaccg

SEQ ID NO: 1401 - DNA, 632 bp, Artificial
  Glycine max FAD3A mutation created with TALEN pair GmFAD3_T02.1
cactgctttgttatgcctacctcatttcatttggctttagacaacttaaatttgagatctttattatgtttttgcttatatggtaaagtgattcattcttcacattgaattgaacagtggccatggaagcttttcagacagcccttttctaaatagcctggtgggcattcctcaattcttgtgccataccatggatggttagttcatcccggcttttttgtttgtcattggaagttcttttattgattcaattttatagcgtgttcggaaacgcgtttcagaaaataatgaaatacatcttgaatctgaaaagttataacttttagcttcattgtcattgaaagttctttattaattatattttattgcgtgtttggaatcccattgagaataagaaatcacgtttaaatgtgaaagttataactattaactttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaattta

SEQ ID NO: 1402 - DNA, 603 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtagcattcctcaattcttgtgccataccatggatggttagttcatcccggcttttttgtttgtcattggaagttctttttattgattcaatttttatagcgtgtttcggaaacgcgtttcagaaaataatgaaaatacatctgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaatcacattttgatgtggaaccaaatctgatttgagaaccaagttgattttgatggattttgcaggagaattagccacagaacttcaccatcaaaatcatggacacattgagaaggatgaatcctgggttccagtatgtgattaact

SEQ ID NO: 1403 - DNA, 705 bp, Artificial
  Glycine max FAD3A mutation created with TALEN pair GmFAD3_T02.1
cactgctttgttatgcctacctcatttcatttggctttagacaacttaaatttgagatctttattatgtttttgcttatatggtaaagtgattcattcttcacattgaattgaacagtggccatggaagcttttcagacagcccttttctaaatagcctggtgggacacccgccatcgtggctggcgatggccaccacctgctgaggggtcaagttgagcggggcacccgtcagtggcattcctcaattcttgtgccataccatggatggttagttcatcccggctttttgtttgtcattggaagttcttttattgattcaatttttatagcgtgttcggaaaacgcgtttcagaaaataatgaaatacatcttgaatctgaaagttataacttttagcttcattgtcattgaaagttcttttattaattatattttattgcgtgtttggaatcccatttgagaaataagaaatcacgtttaaaatgtgaaagttataactattaactttgactaaacttgaaaaattcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaa

SEQ ID NO: 1404 - DNA, 611 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggatggttagttcatcccggcttttttgtttgtcattggaagttcttttattgattcaatttttatagcgtgttcggaaacgcgttttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgattgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaatggaatctttatac

SEQ ID NO: 1405 - DNA, 732 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggaccttgcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacatttttttgtcattatcttagttaaccg

SEQ ID NO: 1406 - DNA, 732 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggattgcattcctcaattcttgtgccataccatggatggttagttcatcccggctttttgttttgtcattggaagttctttttattgaattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatcttatacttcagataaagctgttcttgaacatttttttgtcattatctagttaaccg

SEQ ID NO: 1407 - DNA, 732 bp, Artificial
  Glycine max FAD3A mutation created with TALEN pair GmFAD3_T02.1
cactgctttgttatgcctacctcatttcatttggctttagacaacttaaatttgagatctttattatgtttttgcttatatggtaaagtagattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaattatttatttaataagttcaagaaaaaggaatctttatacttcagataaagctgttcttgaacatttttttgtcatatcttagttaaccg

SEQ ID NO: 1408 - DNA, 733 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacttcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacattttttttgtcattatcttagttaacc

SEQ ID NO: 1409 - DNA, 667 bp, Artificial
  Glycine max FAD3A mutation created with TALEN pair GmFAD3_T02.1
cacttctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacgttatgacccccgccgatgacggtggagacggtccagcaatattggtggcaagcaggcgctggagacggtccagcggctgttgccggtgctgtgccaggccgcattcctcaattcttgtgccataccatggatggttagttcatcccggctttttgtttgtcattggaagttcttttattgattcaattttatagcgtgttcggaaacgcgtttcagaaaataatgaaatacatcttgaatctgaaagttataactttagctcattgtcattgaaagttctttattaattatattttattgcgtgttggaatcccatttgagaaataagaaatcacgtttaaaatgtgaaagttataactattaactttgactaaacttgaaaaaaatcacattttgatgtggaaaccaaatctgatttgagaaccaagttgattttgatggatttgcaggagaaattagccacagaactcaccatcaaaatcatggacacattgagaa

SEQ ID NO: 1410 - DNA, 727 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacagcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggatttgcaggagaattagccacagaactcaccatcaaaatcatggacacattgagaaggatgaatcctgggttccagtatgtgattaactacttcctctatagttatttttgattcaattaaatttattttatttaataaagttcaagaaaaataggaaatctttatacttcagataaagctgttcttgaacatttttttgtcattatct

SEQ ID NO: 1411 - DNA, 728 bp, Artificial
  Glycine max FAD3A mutation created with TALEN pair GmFAD3_T02.1
  misc_feature (673): n is a or c or t or g
cactgctttgttatgcctacctcatttcatttggctttagacaacttaaatttgagatctttattatgtttttgcttatatggtaaagtgattcattcttcacattgaattgaacagtggccatggaagcttttcagacagcccttttctaaatagcctggtagcattcctcaattcttgtgccataccatggatggttagttcatcccggctttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttntacttcagataaagctgttcttgaacattttttttcgtcattatctagttaaccg

SEQ ID NO: 1412 - DNA, 719 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacactgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaagaaagatctttatacttcagataaagctgttcttgaacatttttttgtca

SEQ ID NO: 1413 - DNA, 735 bp, Artificial
  Glycine max FAD3A mutation created with TALEN pair GmFAD3_T02.1
  misc_feature (250); (680): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacattcctcaattcttgtgccataccatggatggttagttcatcccggcttttttgtttgtcattggaagttcttttattgnttcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttntacttcagataaagctgttcttgaacattttttttcgtcattatctagttaaccg

SEQ ID NO: 1414 - DNA, 731 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacaattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacatttttttgtcattatcttagttaaccg

SEQ ID NO: 1415 - DNA, 734 bp, Artificial
  Glycine max FAD3A mutation created with TALEN pair GmFAD3_T02.1
actgctttgttatgcctacctcatttcatttggctttagacaacttaaatttgagatctttattatgtttttgcttatatggtaaagtgattcattcttcacattgaattgaacagtggccatggaagcttttcagacagcccttttctaaatagcctggtgggacactgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacatttttttcgtcattatcttagttaaccg

SEQ ID NO: 1416 - DNA, 732 bp, Artificial
  Glycine max FAD3A mutation created with TALEN pair GmFAD3_T02.1
cactgctttgttatgcctacctcatttcatttggctttagacaacttaaatttgagatctttattatgtttttgcttatatggtaaagtgattcattcttcacattgaattgaacagtggccatggaagcttttcagacagcccttttctaaatagcctggtgggactgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacatttttttgtcattatcttagttaacc

SEQ ID NO: 1417 - DNA, 735 bp, Artificial
  Glycine max FAD3A mutation created with TALEN pair GmFAD3_T02.1
actgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacactgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttgtcattatctagttaaccg

SEQ ID NO: 1418 - DNA, 734 bp, Artificial
  Glycine max FAD3A mutation created with TALEN pair GmFAD3_T02.1
actgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacactgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacatttttttgtcattatctagttaaccg

SEQ ID NO: 1419 - DNA, 733 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacatttttttgtcattatctagttaacc

SEQ ID NO: 1420 - DNA, 637 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaattcggcttttttgtttgtcattggaagttcttttattgattcaatttttatagcgtgttcggaaacgcgtttcagaaaataatgaaatacatcttgaatctgaaagttataacttttagcttcattgtcattgaaaagttcttttattaattatatttttattgcgtgtttggaatccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaaatcatggacacattgagaaggatgaatcctgggttccagtatgtgattaactacttcctctatagttatttttgattcaattaaatttattatttaataagttcaagaaaaaggaatctttatacttcagataaagctg

SEQ ID NO: 1421 - DNA, 666 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggatggttagttcatcccggcttttttgtttgtcattggaagttcttttattgattcaatttttatagcgtgttcggaaacgcgtttcagaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgattgagaaccaagttgattttgatggattttgcaggagaatttagccacagaactcaccatcaaaatcatggacacattgagaaggatgaatcctgggttccagtatgtgattaactacttcctctatagttatttttgattcaattaaatttatttatttaataagttcaagaaaaaatggaatctttatacttcagataaagctgttcttgaacattttttttgtcattatctagttaaccgagaag

SEQ ID NO: 1422 - DNA, 544 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaaatcatttatgttttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaaatcacgtttaaaatgtgaaaagttataactattaacttttgactaaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtaatgtgattaactacttcctctatagtta

SEQ ID NO: 1423 - DNA, 731 bp, Artificial
  Glycine max FAD3A mutation created with TALEN pair GmFAD3_T02.1
  misc_feature (249): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggagcattcctcaattcttgtgccataccatggatggttagttcatcccggcttttttgtttgtcattggaagttcttttattgnttcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgttaaatagtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttattaataagttcaagaaaaaggaatctttatacttcagataaagctgttcttgaacattttttttcgtcattatcttagttaaccg

SEQ ID NO: 1424 - DNA, 830 bp, Artificial
  Glycine max FAD3A mutation created with TALEN pair GmFAD3_T02.1
cactgctttgttatgcctacctcatttcatttggctttagacaacttaaatttgagatctttattatgtttttgcttatatggtaaagtgattcattcttcacattgaattgaacagtggccatggaagcttttcagacagcccttttctaaatagcctggtgggacacgatcttttctacggggtctgacgctcagtggaacgaaaactcacgttaagggattggcgatggccaccacctgctccggggtcaagccgtgggcctggcacagcaccggcaacagccgctggaccatctgcattcctcaattcttgtgccataccatggatggttagttcatcccggctttttgtttgtcattggaagttcttttattgattcaatttttatagcgtgttcggaaacgcgtttcagaaaataatgaaatacatcttgaatctgaaagttataacttttagcttcattgtcattgaaagttctttattaattatattttattgcgtgtttggaatcccatttgagaaataagaaatcacgtttaaaatgtgaaagttataactattaacttttgactaaacttgaaaaaaatcacattttgatgtggaaccaaatctgattgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaac

SEQ ID NO: 1425 - DNA, 660 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaaatcatttatgttttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaaagttataaactattaacttttgactaaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaaggaatctttatacttcagataaagctgttcttgaacattttttttgtcattattcttagttaaccgagaatg

SEQ ID NO: 1426 - DNA, 664 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaatgtgaaagttataactattaacttttgactaaacttgaaaaaattcacatttttgatgtggaaccaaatctgattgagaaccaagttgattttgatggattttgcaggagaatttagccacagaactcaccatcaaaatcatggacacattgagaaggatgaatcctgggttccagtatgtgattaactacttcctctatagttattttgattcaattaaatttatttatttaataagttcaagaaaaaa

SEQ ID NO: 1427 - DNA, 655 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttgtgccataccatggatggttagttcatcccggctttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttattatttaataagttcaagaaaaatggaatctttatacttcagataaagctgttcttgaacattttttttagtcattattcttagttaaccgagaatg

SEQ ID NO: 1428 - DNA, 735 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggattgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaaggaatctttatacttcagataaagctgttcttgaacattttttttgtcattatcttagttaaccg

SEQ ID NO: 1429 - DNA, 735 bp, Artificial
  Glycine max FAD3A mutation created with TALEN pair GmFAD3_T02.1
  misc_feature (681): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacatgcattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttntacttcagataaagctgttcttgaacatttttttcgtcattatctagttaaccg

SEQ ID NO: 1430 - DNA, 736 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacatttttttgtcattatctagttaaccg

SEQ ID NO: 1431 - DNA, 640 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggactgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacatttttgatgtggaaccaaatctgatttgagaaccaagttgattttgatggattttgcaggagaattagccacagaactcaccatcaaaagtcatggacacattgagaaggatgaatcctgggttccagtatgtgattaactacttcctctatagtatttttgattcaatt

SEQ ID NO: 1432 - DNA, 737 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttgtcattatctagttaaccg

SEQ ID NO: 1433 - DNA, 606 bp, Artificial
  Glycine max FAD3A mutation created with TALEN pair GmFAD3_T02.1
cactgctttgttatgcctacctcatttcatttgcttagacaacttaaatttgtagatctttattatgttttttgcttatatggtaaagtgattcattcttcacattgaattgaacagtggccatggaagcttttcagacagcccttttctaaatagcctggtgggacagcattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaaacttgaaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgatt

SEQ ID NO: 1434 - DNA, 733 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtggcttgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttgtcattatctagttaaccg

SEQ ID NO: 1435 - DNA, 735 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtggcttgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttattttatttaataagttcaagaaaaaggaatctttatacttcagataaagctgttcttgaacattttttttgtcattatcttagttaaccg

SEQ ID NO: 1436 - DNA, 733 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacactcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacattttttttcgtcattatcttagttaaccg

SEQ ID NO: 1437 - DNA, 667 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgattgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaatggaatctttatacttcagataaagctgttcttgaacattttttttgtcattatctagtttaaccgagaag

SEQ ID NO: 1438 - DNA, 734 bp, Artificial
  Glycine max FAD3A mutation created with TALEN pair GmFAD3_T02.1
cactgctttgttatgcctacctcatttcatttggctttagacaacttaaatttgagatctttattatgtttttgcttatatggtaaagtgattcattcttcacattgaattgaacagtggccatggaagcttttcagacagcccttttctaaatagcctggtgggacacttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggatttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacatttttttgtcattatctagttaaccg

SEQ ID NO: 1439 - DNA, 733 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacactgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaagaaagatctttatacttcagataaagctgttcttgaacatttttttgtcattatctagttaacc

SEQ ID NO: 1440 - DNA, 730 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttataagttcaagaaaaatggaatctttatacttcagataaagctgttcttgaacatttttttgtcattatctagttaaccg

SEQ ID NO: 1441 - DNA, 733 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtggcttgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacattttttttgtcattatcttagttaaccg

SEQ ID NO: 1442 - DNA, 717 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataactttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttgtca

SEQ ID NO: 1443 - DNA, 720 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggactgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacatttttttcgtca

SEQ ID NO: 1444 - DNA, 731 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggagcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacatttttttgtcattatcttagttaaccg

SEQ ID NO: 1445 - DNA, 732 bp, Artificial
  Glycine max FAD3A mutation created with TALEN pair GmFAD3_T02.1
  misc_feature (677): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgttgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttntacttcagataaagctgttcttgaacattttttttgtcattatctagttaaccga

SEQ ID NO: 1446 - DNA, 487 bp, Artificial
  Glycine max FAD3A mutation created with TALEN pair GmFAD3_T02.1
cactgctttgttatgcctacctcatttcatttggctttagacaacttaaatttgagatctttattatgtttttgcttatatggtaaagtgattcattcttcacattgaattgaacagtggccatggaagcttttcagacagcccttttctaaatagcctggtgggacactgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatccattgagaaataagaaaatcacgtttaaaaatgtgaaagttataactattaacttttgactaaaacttgaaaaaaatcacattttgatgtggaacc

SEQ ID NO: 1447 - DNA, 732 bp, Artificial
  Glycine max FAD3A mutation created with TALEN pair GmFAD3_T02.1
  misc_feature (678): n is a or c or t or g
cactgctttgttatgcctacctcatttcatttggctttagacaacttaaatttgagatctttattatgtttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggatttgcaggagaattagccacagaactcaccatcaaaatcatggacacattgagaaggatgaatcctgggttccagtatgtgattaactacttcctctatagttatttttgattcaattaaatttatttatttaataagttcaagaaaatggaatctttntacttcagataaagctgttcttgaacatttttttgtcattatctagttaaccga

SEQ ID NO: 1448 - DNA, 735 bp, Artificial
  Glycine max FAD3A mutation created with TALEN pair GmFAD3_T02.1
cagctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggaccttgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacattttttttcgtcattatcttagttaaccg

SEQ ID NO: 1449 - DNA, 731 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacttcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacatttttttgtcattatctagttaaccg

SEQ ID NO: 1450 - DNA, 731 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacactcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacattttttttgtcattatcttagttaaccg

SEQ ID NO: 1451 - DNA, 733 bp, Artificial
  Glycine max FAD3A mutation created with TALEN pair GmFAD3_T02.1
  misc_feature (680): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacagcattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaaatctttntacttcagataaagctgttcttgaacatttttttgtcattatctagttaaccg

SEQ ID NO: 1452 - DNA, 734 bp, Artificial; identical to SEQ ID NO: 1438
  Glycine max FAD3A mutation created with TALEN pair GmFAD3_T02.1

SEQ ID NO: 1453 - DNA, 640 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacagcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggatttgcaggagaattagccacagaactcaccatcaaaatcatggacacattgagaaggatgaatcctgggttccagtatgtgattaactacttcctctatagttatttttgattcaatt

SEQ ID NO: 1454 - DNA, 650 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatattttattgcgtgtttggaatcccatttgagaaataagaaatcacgtttaaaatgtgaaagttataactattaacttttgactaaacttgaaaaaatcacatttttgatgtggaaccaaatctgattttgagaaccaagttgattttgatggattttgcaggagaattagccacagaactcaccatcaaaatcatggacacattgagaaggatgaatcctgggttccagtatgtgattaactacttcctctatagttattttgatcaattaaatttattattaataagttcaagaaaaaggaatc

SEQ ID NO: 1455 - DNA, 736 bp, Artificial
  Glycine max FAD3A mutation created with TALEN pair GmFAD3_T02.1
cactgctttgttatgcctacctcatttcatttggctttagacaacttaaatttgagatctttattatgtttttgcttatatggtaaagtgattcattcttcacattgaattgaacagtggccatggaagcttttcagacagcccttttctaaatagcctggtgggacacatgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggatttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttcgtcattatctagttaaccg

SEQ ID NO: 1456 - DNA, 608 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtggcttgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaattctgatttgagaaccaagttgattttgatggattttgcaggagaattagccacagaactcaccatcaaaatcatggacacattgagaaggatgaatcctgggttccagtatgtgattaa

SEQ ID NO: 1457 - DNA, 585 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttccaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaatgtgaaagttataactattaacttttgactaaacttgaaaaaatcacatttttgatgtggaaccaaatctgatttgagaaccaagttgattttgatggattttgcaggagaattagccacagaactcaccatcaaaaatcatggacacattgagaaggatgaatcctgggttccagtatgtgattaactacttcctctatagttattttgattcaattaaatttatttatttaataagttcaagtaaaaaaggaatctttatacttcagataaaagctgttcttgaacatttttttgtcattatcttagttaaccgag

SEQ ID NO: 1458 - DNA, 732 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgttgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacattttttttcgtcattatcttagttaaccg

SEQ ID NO: 1459 - DNA, 631 bp, Artificial
  Glycine max FAD3A mutation created with TALEN pair GmFAD3_T02.1
cactgctttgttatgcctacctcatttcatttggctttagacaacttaaatttgagatctttattattcctcaattcttgtgccataccatggatggttagttcatcccggcttttttgtttgtcattggaagttcttttattgattcaattttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaaagttataactattaacttttgactaaaacttgaaaaaatcacatttttgatgtggaaccaaatctgatttgagaaccaagttgattttgatggatttttgcaggagaattagccacagaactcaccatcaaaatcatggacacattgagaaggatgaattcctgggttccagtatgtgattaactacttcctctatagttatttttgattcaattaaatttatttatttaataagttcaagaaaaaaggatctttatacttcagataaagctgttcttgaacatttttttgtcattatcttagttaaccgag

SEQ ID NO: 1460 - DNA, 734 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacaacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacattttttttgtcattatcttagttaaccg

SEQ ID NO: 1461 - DNA, 735 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacatttttttgtcattatcttagttaaccg

SEQ ID NO: 1462 - DNA, 575 bp, Artificial
  Glycine max FAD3A mutation created with TALEN pair GmFAD3_T02.1
  misc_feature (338); (450): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacagcattcctcaattcttgtgccataccatggatggttagttcatcccggcttttttgtttgtcattggaagttcttttattgattcaatttttatagcgtgttcggaaacgcgtttcagaaaataatgaaaatacatctgaatctgaaaagttataaacttttagcttcnttgtcattgaaagtcttttatttaattatatttttattgcgtgtttggaatcccatttgagaaataagaaatcacgtttaaaaatgtgaaagttataactattaacttttgnctaaacttgaaaaaaactcacattttgatgtggaaccaaaatctgatttgagaaccaagttgattttgatggattttgcaggagaattagccacagaactcaccatcaaaaatcatggacacatt

SEQ ID NO: 1463 - DNA, 635 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttctttattaattatattttattgcgtgtttggaatcccatttgagaaataagaaatcacgtttaaatgtgaaagttataactattaacttttgactaaacttgaaaaaattcacatttttgatgttggaaccaaatctgatttgagaaccaatgttgattttgatggattttgcaggagaatttagccacagaactcaccatcaaaatcatggacacattgagaaggatgaatcctgggttccagtatgtgattaactacttcctctatagttatttttcgattcaattaaattta

SEQ ID NO: 1464 - DNA, 736 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtggcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaataagaaatcacgtttaaaatgtgaaagttataactattaacttttgactaaacttgaaaaaattcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaagggaatctttatacttcagataaatgctgttcttgaacatttttttagtcattatcttagttaaccgagaag

SEQ ID NO: 1465 - DNA, 661 bp, Artificial
  Glycine max FAD3A mutation created with TALEN pair GmFAD3_T02.1
  misc_feature (518): n is a or c or t or g
cactgctttgttattcctacctcatttcatttggctttagacaacttaaatttgagatctttattatgtttttgcttatatggtaaaatcatttatgttttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaagttcttttattaattatatttttattgcgtgtttggaatcccatttgagaaataagaaatcacgtttaaaaatgtgaaaagttataactattaacttttgactaaaacttgaaaaaatcacatttttgatgtggaaccaaattctgatttgagaaccaagttgattttgatggattttgcaggagaattagccacagaactcaccatcaaaatcatggacacattgagaaggatgaatcctgggttccagtatgngattaactacttcctctatagttatttttgattccaattaaaattttattatttaattaagttcaagaaaaaaatggatctttatacttcagataaagctgttcttgaacattttttttagtcattatcttagttaaaccgag

SEQ ID NO: 1466 - DNA, 733 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggactgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaatggaatctttatacttcagataaagctgttcttgaacatttttttcgtcattatctagttaaccg

SEQ ID NO: 1467 - DNA, 573 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatccagcggctgttgccggtgctgtgccaggcccacggcttgaccccggagcaggtggtggccatcgccagcaatattggtggcaagcaggcgctggagacggtgcaggcgctgttgccttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttattaattatattttattgcgtgtttggtaatcccatttgagaaattaagaaatcacgtttaaaatgtgaaagtataactattaacttttgactaaa

SEQ ID NO: 1468 - DNA, 733 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacagcattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacatttttttcgtcattatctagttaaccg

SEQ ID NO: 1469 - DNA, 717 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttt

SEQ ID NO: 1470 - DNA, 717 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggatttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacatttttttgtca

SEQ ID NO: 1471 - DNA, 734 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacaacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacatttttttcgtcattatctagttaaccg

SEQ ID NO: 1472 - DNA, 688 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgttttggaatcccatttgagaaataagaaatcacgtttaaaatgtgaaagttataactattaacttttgactaaacttgaaaaaattcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaagggaatctttatacttcagataaagctg

SEQ ID NO: 1473 - DNA, 726 bp, Artificial
  Glycine max FAD3A mutation created with TALEN pair GmFAD3_T02.1
  misc_feature (680): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggatttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttntacttcagataaagctgttcttgaacatttttttgtcattatctag

SEQ ID NO: 1474 - DNA, 628 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaaatcatttatgttttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttattatttaataagttcaagaaaaaggatctttatacttcagataaagctgttcttgaacatttttttt

SEQ ID NO: 1475 - DNA, 732 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaaggaatctttatacttcagataaagctgttcttgaacatttttttgtcattatcttagttaaccgag

SEQ ID NO: 1476 - DNA, 732 bp, Artificial
  Glycine max FAD3A mutation created with TALEN pair GmFAD3_T02.1
  misc_feature (678): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggatttgcaggagaattagccacagaactcaccatcaaaatcatggacacattgagaaggatgaatcctgggttccagtatgtgattaactacttcctctatagttatttttgattcaattaatttatttattaataagttcaagaaaaatgaatctttntacttcagataaagctgttcttgaacatttttttcgtcattatctagttaaccg

SEQ ID NO: 1477 - DNA, 739 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacatgcattcctcaattcttgtgccataccatggatggttagttcatcccggcttttttgtttgtcattggaagttcttttattgattcaatttttatagcgtgttcggaaacgcgtttcagaaaattaatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttcgtcattatctagttaaccg

SEQ ID NO: 1478 - DNA, 737 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacactgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttcgtcattatctagttaaccg

SEQ ID NO: 1479 - DNA, 735 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacatttttttcgtcattatctagttaaccg

SEQ ID NO: 1480 - DNA, 736 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacatgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacatttttttcgtcattatctagttaaccg

SEQ ID NO: 1481 - DNA, 732 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacatttttttgtcattatcttagttaaccg

SEQ ID NO: 1482 - DNA, 732 bp, Artificial
  Glycine max FAD3A mutation created with TALEN pair GmFAD3_T02.1
  misc_feature (250): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtggcttgcattcctcaattcttgtgccataccatggatggttagttcatcccggcttttttgtttgtcattggaagttcttttattgnttcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaatttatttattataagttcaagaaaaaggaatctttatacttcagataaagctgttcttgaacattttttttcgtcattatcttagttaaccg

SEQ ID NO: 1483 - DNA, 741 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttcgtcattatctagttaaccgagaa

SEQ ID NO: 1484 - DNA, 687 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgaacaggaacttgaactcggtcacgctggaggggtacaccttcctgcattcctcaattcttgtgccataccatggatggttagttcatcccggcttttttgtttgtcattggaagttcttttattgattcaatttttatagcgtgttcggaaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaa

SEQ ID NO: 1485 - DNA, 697 bp, Artificial
  Glycine max FAD3A mutation created with TALEN pair GmFAD3_T02.1
  misc_feature (250): n is a or c or t or g
cactgctttgttatgcctacctcatttcatttggctttagacaacttaaatttgagatctttattatgtttttgcttatatggtaaagtgattcattcttcacattgaattgaacagtggccatggaagcttttcagacagcccttttctaaatagcctggtgggacacattcctcaattcttgtgccataccatggatggttagttcatcccggcttttttgtttgtcattggaagttctttttattgnttcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataattattaacttttgactaaaacttgaaaaaactcacatttttgatgtggaaccaaatctgatttgagaaccaagttgattttgatggatttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctg

SEQ ID NO: 1486 - DNA, 752 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaactcacatttttgatgtggaaccaaatctgatttgagaaccaagtttgattttgatggattttgcaggagaattagccacagaactcaccatcaaaatcatggacacattgagaaggatgaatcctgggttccagtatgtgattaactacttcctctatagttatttttgattcaattaaattttaattttattttaattaaagtttcaagaaaaataggaaatctttataacttcagataaagctgttcttgaacattttttttcgtcattatctaagttaaccgag

SEQ ID NO: 1487 - DNA, 712 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtggggcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaatgtgaaagttataactattaacttttgactaaacttgaaaaaattcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaagggaatctttatacttcagataaagctgttcttgaacattttttt

SEQ ID NO: 1488 - DNA, 734 bp, Artificial
  Glycine max FAD3A mutation created with TALEN pair GmFAD3_T02.1
actgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacactgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacatttttttgtcattatcttagttaaccg

SEQ ID NO: 1489 - DNA, 734 bp, Artificial
  Glycine max FAD3A mutation created with TALEN pair GmFAD3_T02.1
  misc_feature (681): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttntacttcagataaagctgttcttgaacatttttttgtcattatctagttaaccg

SEQ ID NO: 1490 - DNA, 680 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaattcggcttttttgtttgtcattggaagttcttttattgattcaatttttatagcgtgttcggaaacgcgtttcagaaaataatgaaatacatcttgaatctgaaagttataacttttagcttcattgtcattgaaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaaatcatggacacattgagaaggatgaatcctgggttccagtatgtgattaactacttcctctatagttatttttgattcaattaaatttatttatttaataagttcaagaaaaaggaatctttatacttcagataaagctgttacttgaacattttttttgtcattatcttagttaaccgag

SEQ ID NO: 1491 - DNA, 679 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaattcggcttttttgtttgtcattggaagttcttttattgattcaatttttatagcgtgttcggaaacgcgtttcagaaaataatgaaatacatcttgaatctgaaagttataacttttagcttcattgtcattgaaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaaatcatggacacattgagaaggatgaatcctgggttccagtatgtgattaactacttcctctatagttattttgattcaattaaatttatttatttaataagttcaagaaaaaggaatctttatacttcagataaagctgttacttgaacattttttttgtcattatcttagttaaccgag

SEQ ID NO: 1492 - DNA, 711 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatattttattgcgtgtttggaatcccatttgagaaataagaaatcacgtttaaaaattgtgaaagttataactattaacttttgactaaacttgaaaaaactcacatttttgatgtggaaccaaatctgatttgagaaccaagttgatttgatggattttgccaggagaattagccacagaactcaccatcaaaatcatggacacattgagaaggatgaatcctgggttccagtatgtgattaactacttcctctatagttattttgattcaattaaatttatttattaataagttcaagaaaaaggaatcttatacttcagataaagctgttcttgaacatttttttagtcattatcttagttaaccgag

SEQ ID NO: 1493 - DNA, 720 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggattgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagtttcaagaaaaaggaatctttatacttcagataaagctgttcttgaacattttttttcgtca

SEQ ID NO: 1494 - DNA, 741 bp, Artificial
  Glycine max FAD3A mutation created with TALEN pair GmFAD3_T02.1
cactgctttgttatgcctacctcatttcatttggctttagacaacttaaatttggagatttctttattatttgtttttgcttatatggtaaagtgattcattcttcacattgaattgaacagtggccatggaagcttttcagacagcccttttctaaatagcctggtgggacacatcttcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttgtcattacttagt

SEQ ID NO: 1495 - DNA, 441 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcatttttcacattgaattgaacattcctcaattcttgtgccataccatggatggttagttcatcccggcttttttgtttgtcattggaagttcttttattgattcaatttttatagcgtgttcggaaacgcgtttcagaaataatgaaatacatcttgaatctgaaagttataacttttagcttcattgtcattgaaaagttcttttattaattatatttttattgcgtgtttggaatccatttgagaaatagaaatcacgtttaaaatgtgaaagttataactattaacttttgactaaacttgaaaaaattcacatttttgatgtggaaccaaatctgatttgag

SEQ ID NO: 1496 - DNA, 689 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatattttatttgcgtgtttggaatcccatttgagaaataagaaatcacgtttaaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaaggaatctttatacttcagataaagctgttcttgaacatttttttt

SEQ ID NO: 1497 - DNA, 734 bp, Artificial
  Glycine max FAD3A mutation created with TALEN pair GmFAD3_T02.1
cactgctttgttatgcctacctcatttcatttggctttagacaacttaaatttgagatctttattatgtttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacatttttttcgtcattatctagttaaccg

SEQ ID NO: 1498 - DNA, 734 bp, Artificial; identical to SEQ ID NO: 1489
  Glycine max FAD3A mutation created with TALEN pair GmFAD3_T02.1
  misc_feature (681): n is a or c or t or g

SEQ ID NO: 1499 - DNA, 732 bp, Artificial
  Glycine max FAD3A mutation created with TALEN pair GmFAD3_T02.1
  misc_feature (679): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacgcattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaacctacttcctctatagttatttttgattcaattaatttatttatttataagttcaagaaaaatggaatctttntacttcagataaagctgttcttgaacatttttttttccattatctagttaacc

SEQ ID NO: 1500 - DNA, 736 bp, Artificial
  Glycine max FAD3A mutation created with TALEN pair GmFAD3_T02.1
  misc_feature (681): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttntacttcagataaagctgttcttgaacattttttttcgtcattatctagttaaccg

SEQ ID NO: 1501 - DNA, 732 bp, Artificial
  Glycine max FAD3A mutation created with TALEN pair GmFAD3_T02.1
  misc_feature (679): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttntacttcagataaagctgttcttgaacatttttttcgtcattatctagttaacc

SEQ ID NO: 1502 - DNA, 571 bp, Artificial
  Glycine max FAD3A mutation created with TALEN pair GmFAD3_T02.1
cactgctttgttatgcctacctcatttcatttggctttagacaacttaaatttgagatctttattatgtttttgcttatatggtaaagtgattcattcttcacattgaattgaacagtggccatggaagcttttcagacagcccttttctaaatagcctggtgggacgcattcctcaaattcttgtgccataccatggatggttagttcatcccggcttttttgttgtcattggaagttctttttattgatcaatttttatagcggttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggatttgcaggagaattagccacagaactcaccatcaaaatcatggacacattgagaa

SEQ ID NO: 1503 - DNA, 733 bp, Artificial
  Glycine max FAD3A mutation created with TALEN pair GmFAD3_T02.1
  misc_feature (679): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacgcattcctcaattcttgtgccataccatggatggttagttcatcccggcttttttgtttgtcattggaagttctttttattgattcaatttttatagcgtgttcggaaacgcgtttcaggaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttataagttcaagaaaaatggaatctttntacttcagataaagctgttcttgaacatttttttcgtcattatctagttaaccg

SEQ ID NO: 1504 - DNA, 733 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggactgcattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacattttttttgtcattatcttagttaaccg

SEQ ID NO: 1505 - DNA, 734 bp, Artificial; identical to SEQ ID NO: 1418
  Glycine max FAD3A mutation created with TALEN pair GmFAD3_T02.1

SEQ ID NO: 1506 - DNA, 726 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggatttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacatttttttgtcattatct

SEQ ID NO: 1507 - DNA, 694 bp, Artificial
  Glycine max FAD3A mutation created with TALEN pair GmFAD3_T02.1
  misc_feature (255): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggactcttgcattcctcaattcttgtgccataccatggatggttagttcatcccggcttttttgtttgtcattggaagttctttttattgnttcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaatttattttatttaataagttcaagaaaaatggaatctttatacttcaga

SEQ ID NO: 1508 - DNA, 746 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacactgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggatttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacatttttttcgtcattatctagttaaccgagaagcttggg

SEQ ID NO: 1509 - DNA, 695 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaagttataactattaacttttgactaaacttgaaaaaatcacattttgatgtggaaccaaatctgatttgagaaccaagttgatttttgatggattttgcaggagaattagccacagaactcaccatcaaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacattttttttgtcattatcttagttaacc

SEQ ID NO: 1510 - DNA, 686 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgaatttgagaaccaatgttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaaggaatctttatacttcagataaagctg

SEQ ID NO: 1511 - DNA, 731 bp, Artificial
  Glycine max FAD3A mutation created with TALEN pair GmFAD3_T02.1
  misc_feature (678): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttntacttcagataaagctgttcttgaacatttttttcgtcattatctagttaacc

SEQ ID NO: 1512 - DNA, 735 bp, Artificial
  Glycine max FAD3A mutation created with TALEN pair GmFAD3_T02.1
  misc_feature (680): n is a or c or t or g
actgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacactgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggatttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttntacttcagataaagctgttcttgaacattttttttcgtcattatctagttaaccg

SEQ ID NO: 1513 - DNA, 583 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaaggaatctttatacttcagataaagctgttcttgaacattttttttgtcattatcttagttaaccgag

SEQ ID NO: 1514 - DNA, 723 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacatttttttgtcattatct

SEQ ID NO: 1515 - DNA, 715 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttt

SEQ ID NO: 1516 - DNA, 735 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtggcttgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacattttttttcgtcattatcttagttaaccg

SEQ ID NO: 1517 - DNA, 736 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttgtcattatctaagttaaccg

SEQ ID NO: 1518 - DNA, 733 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacatcattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacatttttttgtcattatctaagttaaccg

SEQ ID NO: 1519 - DNA, 727 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttcgtcattatct

SEQ ID NO: 1520 - DNA, 734 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaattatttatttaataagttcaagaaaaaggaatctttatacttcagataaagctgttcttgaacatttttttgtcattatcttagttaaccg

SEQ ID NO: 1521 - DNA, 734 bp, Artificial
  Glycine max FAD3A mutation created with TALEN pair GmFAD3_T02.1
actgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacactgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggatttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttgtcattatctagttaaccg

SEQ ID NO: 1522 - DNA, 734 bp, Artificial; identical to SEQ ID NO: 1471
  Glycine max FAD3A mutation created with TALEN pair GmFAD3_T02.1

SEQ ID NO: 1523 - DNA, 711 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttctgacagcccttttctaaatagcctgggcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaatgtgaaagttataactattaacttttgactaaacttgaaaaaattcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaagggaatctttatacttcagataaagctgttcttgaacatttttttt

SEQ ID NO: 1524 - DNA, 735 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacaacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttattttatttaataagttcaagaaaaatggaatctttatacttcagataaagctgttcttgaacatttttttcgtcattatctagttaaccg

SEQ ID NO: 1525 - DNA, 731 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacatttttttgtcattatctagttaaccg

SEQ ID NO: 1526 - DNA, 733 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacaattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttcgtcattatctagttaaccg

SEQ ID NO: 1527 - DNA, 732 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagtatttttgattcaattaaatttatttatttaataagttcaagaaaaatggaatctttatacttcagataaagctgttcttgaacatttttttcgtcattatctagttaacc

SEQ ID NO: 1528 - DNA, 734 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggatttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacattttttttgtcattatcttagttaaccg

SEQ ID NO: 1529 - DNA, 734 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacatgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacatttttttgtcattatctagttaaccg

SEQ ID NO: 1530 - DNA, 616 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggatgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggagtcccatttgagaaataagaaatcacgtttaaaatgtgaaagttataactattaacttttgactaaacttgaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctcta

SEQ ID NO: 1531 - DNA, 771 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacagcgcctgcttgccgccatcgtggctggcgatggccaccacctgctccggggtcaagccgtgggcctggcacagcaccggcaacagccgctggattcctcaattcttgtgccataccatggatggttagttcatcccggctttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatattttattgcgtgtttggaatcccatttgagaaataagaaatcacgtttaaaatgtgaaagttataactattaacttttgactaaacttgaaaaaatcacatttttgatgtggaaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaatttatttatttaataagttcaagaaaaaggaatctttatac

SEQ ID NO: 1532 - DNA, 676 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcattcctcaattcttgtgccataccatggatggttagttcatcccggcttttttgtttgtcattggaagttcttttattgattcaatttttatagcgtgttcggaaacgcgtttcagaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaaatcatggacacattgagaaggatgaatcctgggttccagtatgtgattaactacttcctctatagttattttgattcaattaaaattttatttatttaataagttcaagaaaaaaggaaatctttatacttcagataaagctgttcttgaacattttttttg

SEQ ID NO: 1533 - DNA, 734 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacagcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttgtcattatctagttaaccg

SEQ ID NO: 1534 - DNA, 738 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatctaggtgactggtgagtactcaaccaagtcattctgagaatagtgtatgcggcgaccgagttgctcttgcccggcgtcaatacgggataataccgttgctcttgtctagattcttgttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatattttattgcgtgtttggaatcccatttgagaaataagaaatcacgtttaaaatgtgaaagttataactattaacttttgactaaaacttgaaaaaatcacatttttgatgtggaaccaaatctgatttgagaaccaagttgatttttgatggattttgcaggagaattagccacagaactcaccatcaaaatcatggacacattgagaaggatgaatcctgggttccagtatgtgattaagctacttcctc

SEQ ID NO: 1535 - DNA, 735 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggattgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttcgtcattatctagttaaccg

SEQ ID NO: 1536 - DNA, 750 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacagccgtggccctcggcgggcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaagttcttttattaattatatttttattgcgtgtttggaatcccatttgagaaataagaaatcacgtttaaatgtgaaagttataactattaacttttgactaaacttgaaaaaattcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaaattaaatttatttattttaataagttcaagaaaaatggaatcttttatacttcagataaagctgttcttgaacattttttttagtcattatcttag

SEQ ID NO: 1537 - DNA, 733 bp, Artificial; identical to SEQ ID NO: 1419
  Glycine max FAD3A mutation created with TALEN pair GmFAD3_T02.1

SEQ ID NO: 1538 - DNA, 734 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacatttttttgtcattatctagttaaccg

SEQ ID NO: 1539 - DNA, 733 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaatgtgaaagttataactattaacttttgactaaacttgaaaaaattcacatttttgatgtggaaccaaatctgatttgagaaccaagttgattttgatggattttgcaggagaattagccacagaactcaccatcaaaattcatggacacattgagaaggatgaatcctgggttccagtatgtgattaactacttcctctatagttatttttgattcaattaaatttatttatttaataagttcaagaaaaagggaatctttatacttcagataaagctgttcttgaacattttttttagtcattatcttagttaaccgag

SEQ ID NO: 1540 - DNA, 734 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggatgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttcgtcattatctagttaacc

SEQ ID NO: 1541 - DNA, 708 bp, Artificial
  Glycine max FAD3A mutation created with TALEN pair GmFAD3_T02.1
cactgctttgttatgcctacctcatttcatttggctttagacaacttaaatttgagatctttattatgtttttgcttatatggtaaagtgattcattcttcacatttgaattgaacagtggccatggaagcttttcagacagcccttttctaaatagcctggtgggacattcctcaattcttgtgccataccatggatggttagttcatcccggctttttgtttgtcattggaagttcttttattgattcaatttttatagcgtgttcggaaacgcgtttcagaaaataatgaaaatacatcttgaatctgaaaagttataacttttagcttcattgtcattgaaagcttcttttattaattatatttttattgcgtgtttggaatcccattgagaaataagaaatcacgttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgatcaattaaatttatttatttaataagttcaagaaaaaaggaatctttatacttcagataaagctgttcttgaacattttttt

SEQ ID NO: 1542 - DNA, 729 bp, Artificial
  Glycine max FAD3A mutation created with TALEN pair GmFAD3_T02.1
  misc_feature (617): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctcnatagttatttttgattcaattaaatttatttatttaataagttcaagaaaaatggaatctttatacttcagataaagctgttcttgaacattttttttcgtcattatcttag

SEQ ID NO: 1543 - DNA, 739 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttcgtcattatctagttaaccg

SEQ ID NO: 1544 - DNA, 701 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttattttatttaataagttcaagaaaaatggaatctttatacttcagataaagctgttc

SEQ ID NO: 1545 - DNA, 731 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacatttttttgtcattatcttagttaacc

SEQ ID NO: 1546 - DNA, 734 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacatgcattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacatttttttcgtcattatctagttaaccg

SEQ ID NO: 1547 - DNA, 811 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacagcgcctgcttgccgccatcgtggctggcgatggccaccacctgctccggggtcaagccgtgggcctggcacagcaccggcaacagccgctggattcctcaattcttgtgccataccatggatggttagttcatcccggctttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatattttattgcgtgttggaatcccatttgagaaataagaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaagggatgaatcctgggttccagtatgtgattaactacttcctctatagttatttttgattcaattaattttatttattaataagttcaagaaaaaggaatctttatacttcagataaagctgttcttgaaacatttttttcgtcattatc

SEQ ID NO: 1548 - DNA, 734 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacatgcattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacattttttttgtcattatcttagttaaccg

SEQ ID NO: 1549 - DNA, 629 bp, Artificial
  Glycine max FAD3A mutation created with TALEN pair GmFAD3_T02.1
  misc_feature (392); (479): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaaatgtgaaaagttataactattaacttttgactaaaacttgaaaaaatcacatttttgatgnggaaccaaatctgatttgagaaccaagttgattttgatggattttgcaggaagaattagccacagaactcaccatcaaaatcatggncacattgagaaggatgaatcctgggttccagtatgtgattaactacttcctctatagttattttgattcaattaaaatttatttatttaataagtcaagaaaaaaggaatctttatacttcagataaagctgttcttgaacatttttttt

SEQ ID NO: 1550 - DNA, 694 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacagcattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagtttcaagaaaaaggaatctttatacttcagataaagc

SEQ ID NO: 1551 - DNA, 736 bp, Artificial; identical to SEQ ID NO: 1430
  Glycine max FAD3A mutation created with TALEN pair GmFAD3_T02.1

SEQ ID NO: 1552 - DNA, 686 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttcttttattaattatatttttattgcgtgtttggaatcccatttgagaaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaaatcatggacacattgagaaggatgaatcctgggttccagtatgtgattaactacttcctctatagttatttttgattcaattaaaatttatttatttaataagttcaagaaaaaaggaatctttatacttcagataaagctgttcttgaacattttttttgtcattatc

SEQ ID NO: 1553 - DNA, 739 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggactgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacatttttttgtcattatctagttaaccgagaagc

SEQ ID NO: 1554 - DNA, 623 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggattgcattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggatttcgcaggagaattagccacagaactcaccatcaaaatcatggacacattgagaaggatgaatcctgggttccagtatgtgattaacctacttcctctatag

SEQ ID NO: 1555 - DNA, 734 bp, Artificial; identical to SEQ ID NO: 1489
  Glycine max FAD3A mutation created with TALEN pair GmFAD3_T02.1
  misc_feature (681): n is a or c or t or g

SEQ ID NO: 1556 - DNA, 732 bp, Artificial
  Glycine max FAD3A mutation created with TALEN pair GmFAD3_T02.1
  misc_feature (678): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtggcttgcattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttntacttcagataaagctgttcttgaacattttttttgtcattatctagttaaccg

SEQ ID NO: 1557 - DNA, 725 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacatttttttgtcattatct

SEQ ID NO: 1558 - DNA, 735 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttgtcattatctagttaaccg

SEQ ID NO: 1559 - DNA, 736 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacagcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacatttttttcgtcattatctagttaaccg

SEQ ID NO: 1560 - DNA, 637 bp, Artificial
  Glycine max FAD3A mutation created with TALEN pair GmFAD3_T02.1
  misc_feature (391): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaaagttataactattaacttttgactaaaacttgaaaaaatcacatttttgatgnggaaccaaatctgatttgagaaccaagttgattttgatggattttgcaggaagaattagccacagaactcaccatcaaaatcatggacacattgagaaggatgaatcctgggttccagtaatgtgattaactacttcctctatagttatttttgattcaattaaatttatttatttaataagttcaagaaaaaggaatctttatacttcagataaagctgttcttgaacattttttttgtcattat

SEQ ID NO: 1561 - DNA, 710 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaatgtgaaagttataactattaacttttgactaaacttgaaaaaattcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaagggaatctttatacttcagataaagctgttcttgaacattttttt

SEQ ID NO: 1562 - DNA, 734 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttattttatttaataagttcaagaaaaaggaatctttatacttcagataaagctgttcttgaacatttttttgtcattatcttagttaaccg

SEQ ID NO: 1563 - DNA, 735 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggaccattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaacctacttcctctatagttatttttgattcaattaaatttatttatttaataagttcaagaaaaaggaatctttatacttcagataaagctgttcttgaacattttttttcgtcattatcttagttaaccg

SEQ ID NO: 1564 - DNA, 725 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggactgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttataacttcagataaagctgttcttgaacatttttttgtcattatct

SEQ ID NO: 1565 - DNA, 731 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtggggcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttattaataagttcaagaaaaaaggaatcttatacttcagataaagctgttcttgaacatttttttgtcattatcttagttaaccgag

SEQ ID NO: 1566 - DNA, 734 bp, Artificial; identical to SEQ ID NO: 1538
  Glycine max FAD3A mutation created with TALEN pair GmFAD3_T02.1

SEQ ID NO: 1567 - DNA, 644 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaaatcatttatgttttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttattatttaataagttcaagaaaaatggaatctttatacttcagataaagctgttcttgaacattttttttagtcattatctta

SEQ ID NO: 1568 - DNA, 735 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacatttttttcgtcattatctagttaaccg

SEQ ID NO: 1569 - DNA, 728 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcccttttcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaagggaatctttatacttcagataaagctgttcttgaacattttttttagtcattatcttagttaaccgag

SEQ ID NO: 1570 - DNA, 637 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaataagaaatcacgtttaaaatgtgaaagttataactattaactttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaattta

SEQ ID NO: 1571 - DNA, 739 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatggagttatttttgattcaattaaatttatttatttaataagttcaagaaaaatggaatctttatacttcagataaagctgttcttgaacattttttttcgtcattatctagttaaccg

SEQ ID NO: 1572 - DNA, 736 bp, Artificial
  Glycine max FAD3A mutation created with TALEN pair GmFAD3_T02.1
  misc_feature (682): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacatgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagtatttttgattcaattaaatttatttatttaataagttcaagaaaaatggaatctttntacttcagataaagctgttcttgaacatttttttcgtcattatctagttaaccg

SEQ ID NO: 1573 - DNA, 735 bp, Artificial
  Glycine max FAD3A mutation created with TALEN pair GmFAD3_T02.1
  misc_feature (680): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggatgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaatttatttatttaataagttcaagaaaaatggaatctttntacttcagataaagctgttcttgaacattttttttcgtcattatctagttaaccg

SEQ ID NO: 1574 - DNA, 731 bp, Artificial
  Glycine max FAD3A mutation created with TALEN pair GmFAD3_T02.1
cactgctttgttatgcctacctcatttcatttggctttagacaacttaaatttgagatctttattatgtttttgcttatatggtaaagtgattcattcttcacattgaattgaacagtggccatggaagcttttcagacagcccttttctaaatagcctggtggcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaatgtgaaagttataactattaactttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaagggaatctttatacttcagataaagctgttcttgaacatttttttagtcattatcttagttaaccgag

SEQ ID NO: 1575 - DNA, 739 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaaatacatcttgaatctgaaaagttataacttttagcttcattgtcattgaaaagttcttttattaattatatttttattgcgtgtttggaatcccatttgagaaataagaaaatcacgtttaaaaatgtgaaagttataactattaacttttgactaaaacttgaaaaaaatcacattttgatgtggaaccaaaatctgatttgagaaccaagttgattttgatggattttgcaggagaattagccacagaaactcaccatcaaaatcatggacacattgagaaggatgaatcctgggttccatatgtgattaactaacttctctactagttatttttgaatttcaattaaaatttaattttatttaaattaaagttcaagaaaaataggaaaagatctttataacttcagataaaagctgttcttgaacatttttttt

SEQ ID NO: 1576 - DNA, 772 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacagtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgcattcctcaattcttgtgccataccatggatggttagttcatcccggctttttgttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaataagaaatcacgtttaaaatgtgaaagttataactattaactttgactaaacttgaaaaactcacatttttgatgtggaaccaaatctgatttgagaaccaagttgattttgatggattttgcaggagaattagccacagaactcaccatcaaaatcatggacacattgagaaggatgaattcctgggttccagtatgtgattaactacttcctctatagttatttttga

SEQ ID NO: 1577 - DNA, 731 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggagcattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacattttttttgtcattatcttagttaaccg

SEQ ID NO: 1578 - DNA, 722 bp, Artificial
  Glycine max FAD3A mutation created with TALEN pair GmFAD3_T02.1
cactgctttgtatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacacgggcccgtcgactgcagaggcctgcatgcaagcttggcgtaatcatggtcatagctgtttcctgtgtgaaattgttatcctgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatattttattgcgtgttggaatcccatttgagaaataagaaatcacgtttaaaatgtgaaagttataactattaactttgactaaactgaaaaaaagtcacatttttgatgtggaaaccaaatctgatttgagaaccaagttgattttgatggattttgcaggagaattagccacagaactcaccatcaaaatcatggacacaattgagaaggatgaaatcctgggttccagtatgtgattaactatcttcctctatagttatttttgattcaatt

SEQ ID NO: 1579 - DNA, 735 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacaccgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacatttttttcgtcattatctagttaacc

SEQ ID NO: 1580 - DNA, 733 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacttcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaaggaatctttatacttcagataaagctgttcttgaacattttttttgtcattatcttagttaaccg

SEQ ID NO: 1581 - DNA, 733 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacgcattcctcaattcttgtgccataccatggatggttagttcatcccggcttttttgtttgtcattggaagttctttttattgattcaatttttatagcgtgttcggaaacgcgtttcaggaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttataagttcaagaaaaatggaatctttatacttcagataaagctgttcttgaacatttttttcgtcattatctagttaaccg

SEQ ID NO: 1582 - DNA, 702 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacagcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaataggaaatctttatacttcagataaagctgttc

SEQ ID NO: 1583 - DNA, 728 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcaattcttgtgccataccatggatggttagttcatcccggcttttttgtttgtcattggaagttcttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacattttttttgtcattatcttagttaaccg

SEQ ID NO: 1584 - DNA, 735 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttcgtcattatctagttaaccg

SEQ ID NO: 1585 - DNA, 733 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacatgcattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacatttttttcgtcattatctagttaacc

SEQ ID NO: 1586 - DNA, 736 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtggggcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaatgtgaaagttataactattaacttttgactaaacttgaaaaaattcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaagggaatctttatacttcagataaagctgttcttgaacatttttttagtcattatcttagttaaccgag

SEQ ID NO: 1587 - DNA, 737 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctgggcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaatgtgaaagttataactattaacttttgactaaacttgaaaaaattcacatttttgatgtggaaccaaatctgatttgagaaccaagttgattttgatggattttgcaggagaatttagccacagaactcaccatcaaaatcatggacacattgagaaggatgaatcctgggttccagtatgtgattaactacttcctctatagttattttcgattcaattaaatttatttatttaataagttcaagaaaaaagggaatctttatacttcagataaagctgttcttgaacatttttttagtcattatcttagttaaccgagaag

SEQ ID NO: 1588 - DNA, 606 bp, Artificial
  Glycine max FAD3A mutation created with TALEN pair GmFAD3_T02.1
cactgctttgttatgcctacctcatttcatttgctttatgacaacttaaatttgagatctttattatgttttttgcttatatggtaaagtagattcattcttcacattgaattgaacagtggccatggaagcttttcagacagcccttttctaaatagcctggtgggacagcattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggatttgcaggagaattagccacagaactcaccatcaaaatcatggacacattgagaaggatgaatcctgggttccagtatgtgattaa

SEQ ID NO: 1589 - DNA, 648 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgaattaactacttcctctatagttatttttgattcaattaaattta

SEQ ID NO: 1590 - DNA, 737 bp, Artificial
  Glycine max FAD3A mutation created with TALEN pair GmFAD3_T02.1
  misc_feature (251): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacagcattcctcaattcttgtgccataccatggatggttagttcatcccggcttttttgtttgtcattggaagttcttttattgnttcaatttttatagcgtgttcggaaacgcgtttcagaaaataatgaaaatacatcttgaatctgaaagttataacttttagctcattgtcattgaaagttcttttattaattatatttttattgcgtgtttggaatcccatttgagaaataagaaatcacgtttaaaatgtgaaagttataactattaacttttgactaaacttgaaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaacctacttcctctatagttatttttgattcaattaatttatttatttaataagttcaagaaaaatggaatctttatacttcagataaagctgttcttgaacattttttttcgtcattatcttagttaaccg

SEQ ID NO: 1591 - DNA, 735 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacagcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttcgtcattatctagttaaccg

SEQ ID NO: 1592 - DNA, 497 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatt

SEQ ID NO: 1593 - DNA, 726 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacactgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaagaaagatctttatacttcagataaagctgttcttgaacattttttttcgtcattatc

SEQ ID NO: 1594 - DNA, 743 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttgtcattatctagttaaccg

SEQ ID NO: 1595 - DNA, 733 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttataagttcaagaaaaatggaatctttatacttcagataaagctgttcttgaacatttttttcgtcattatctagttaaccg

SEQ ID NO: 1596 - DNA, 584 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttcaaacactcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttcttttattaattatattttattgcgtgtttggaatcccatttgagaaataagaaatcacgtttaaaatgtgaaagttataactattaacttttgactaaacttgaaaaaatcacattttgatgtggaaccaaattctgatttgagaaccaagttgaattttgatggattttgcatggagaattagccacagaactcaccattcaaaatcatggacacattgagaaggatgaatcctgggttccagtatgtga

SEQ ID NO: 1597 - DNA, 728 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggactcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaataagaaatcacgtttaaaatgtgaagttataactattaacttttgactaaacttgaaaaaattcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaagggaatctttatacttcagataaagctgttcttgaacatttttttgtcattatcttagttaaccgag

SEQ ID NO: 1598 - DNA, 728 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacatttttttcgtcattatctag

SEQ ID NO: 1599 - DNA, 706 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatattttattgcgtgtttggaatcccatttgagaaataagaaatcacgtttaaaatgtgaaagttataactattaacttttgactaaacttgaaaaaatcacatttttgatgtggaaccaaatctgattttgagaaccaagttgattttgatggattttgcaggagaattagccacagaactcaccatcaaaatcatggacacattgagaaggatgaatcctgggttccagtatgtgattaactacttcctctatagttattttgattcaattaaatttattattaataagttcaagaaaaagggaatctttatacttcagataaagctgttcttgaacatttttttagtcattatcttagttaaccgag

SEQ ID NO: 1600 - DNA, 722 bp, Artificial
  Glycine max FAD3A mutation created with TALEN pair GmFAD3_T02.1
  misc_feature (678): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttntacttcagataaagctgttcttgaacatttttttgtcattatct

SEQ ID NO: 1601 - DNA, 592 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttcttttattaattatatttttattgcgtgtttggaatcccatttgagaaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaaatcatggacacattgagaaggatgaatcctgggttccagtatgtgattaactacttcctctatagtta

SEQ ID NO: 1602 - DNA, 736 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacatttttttcgtcattatctagttaaccg

SEQ ID NO: 1603 - DNA, 734 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtggggcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaaaggaatctttatacttcagataaagctgttcttgaacatttttttgtcattatcttagttaaccgag

SEQ ID NO: 1604 - DNA, 733 bp, Artificial; identical to SEQ ID NO: 1441
  Glycine max FAD3A mutation created with TALEN pair GmFAD3_T02.1

SEQ ID NO: 1605 - DNA, 617 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatattttattgcgtgttggaatcccattgagaataagaaatcacgtttaaaatgtgaaagttataactattaacttttgactaaacttgaaaaaattcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagtta

SEQ ID NO: 1606 - DNA, 426 bp, Artificial
  Glycine max FAD3A mutation created with TALEN pair GmFAD3_T02.1
  misc_feature (239): n is a or c or t or g
cactgctttgttatgcctacctcatttcatttggctttagacaacttaaatttgagatctttattatgttttttgcttatatggtaaagtgattcattcttcacattgaattgaacagtggccatggatggttagttcatcccggcttttttgtttgtcattggaagttcttttattgattcaatttttatagcgtgttcggaaacgcgtttcagaaaataatgaaatacatcttgaanctgaaagttataactttttagcttcattgtcattgaaagtcttttattaattatatttttattgcgtgtttggatcccatttgagaaataagaaatcacgtttaaaatgtgaaaagttataactattaacttttgactaaacttgaaaaaatcacatttttgatgtggaaccaaatctgattgagaa

SEQ ID NO: 1607 - DNA, 710 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggaattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaatgtgaaagttataactattaacttttgactaaacttgaaaaaattcacatttttgatgtggaaccaaatctgattgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaaggaatctttatacttcagataaagctgttcttgaacattttttt

SEQ ID NO: 1608 - DNA, 716 bp, Artificial
  Glycine max FAD3A mutation created with TALEN pair GmFAD3_T02.1
  misc_feature (681): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggattgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttntacttcagataaagctgttcttgaacatttttttt

SEQ ID NO: 1609 - DNA, 732 bp, Artificial
  Glycine max FAD3A mutation created with TALEN pair GmFAD3_T02.1
  misc_feature (688): n is a or c or t or g
cactgctttgttatgcctacctcattcatttgctttatgacaacttaaatttgagatctttattatgttttttgcttatatggtaaagtgattcattcttcacattgaattgaacagtggccatggaagcttttcagacagcccttttctaaatagcctggtgggacacatcttcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggatttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttntacttcagataaagctgttcttgaacattttttttgtcattatc

SEQ ID NO: 1610 - DNA, 737 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggattgcattcctcaattcttgtgccataccatggatggttagttcatcccggctttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttattttatttaataagttcaagaaaaaaggaatctttatacttcagataaagctgttcttgaacattttttttgtcattatcttagttaaccg

SEQ ID NO: 1611 - DNA, 725 bp, Artificial
  Glycine max FAD3A mutation created with TALEN pair GmFAD3_T02.1
cactgctttgatatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacactattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacatttttttcgtcattatct

SEQ ID NO: 1612 - DNA, 734 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggatgcattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaatttatttatttataagttcaagaaaaaggaatctttatacttcagataaagctgttcttgaacattttttttcgtcattatcttagttaaccg

SEQ ID NO: 1613 - DNA, 704 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacatcattcctcaattcttgtgccataccatggatggttagttcatcccggcttttttgttgtcattggaagttctttttattgatcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaataggaatctttataacttcagataaagctgttcttg

SEQ ID NO: 1614 - DNA, 713 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttt

SEQ ID NO: 1615 - DNA, 602 bp, Artificial
  Glycine max FAD3A mutation created with TALEN pair GmFAD3_T02.1
  misc_feature (411): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacggtcctgggtgctggagacggcttgccaccaatattgctggcgatggccaccacctgctccggggtcaagccgtgggcctggcacagcaccggcaacagccgctggaccgtctccagcgcctgcttgccaccaatattgctggcgatggccaccacctgctccggggtcaagccgtgggccttgcattcctcaattcttgtgccataccatggatggttagttcatcccggctttttgtttgncattggaagttcttttattgattcaatttttatagcgtgttcggaaacgcgttcagaaaaataatgaaatacatcttgaatctgaaagttataacttttaagcttcattgtcattgaaagttctttattaattaatattttattgcgtgtttggaatccattgagaaataagaaatcacgtttaaaatgtg

SEQ ID NO: 1616 - DNA, 837 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatgttgccggtgctgtgccaggcccacggcttgacccccacgacaggtggtggccatcgccagcaataatggtggcaagcaggcgctggagacggtccagcattcctcaattcttgtgccataccatggatggttagttcatcccggcttttttgtttgtcattggaagttctttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaatcacatttttgatgtggaaccaaatctgatttgagaaccaagttgattttgatggattttgcaggagaattagccacagaactcaccatcaaaatcatggacacattgagaagggatgaatcctgggttccagtatgtgattactacttcctctatagttatttttggattcaatttaattttatttatttaataagttcaagaaaaacggaatctttatacttcagataaagctgttcttgaaacatttttttcgtcattatctttagttaacc

SEQ ID NO: 1617 - DNA, 727 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacatgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatttggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacatttttttgtcattatct

SEQ ID NO: 1618 - DNA, 648 bp, Artificial
  Glycine max FAD3A mutation created with TALEN pair GmFAD3_T02.1
actgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacactgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggatttgcaggagaattagccacagaactcaccatcaaaatcatggacacattgagaaggatgaatcctgggttccagtatgtgattaactacttcctctatagttatttttgattcaattaatttattt

SEQ ID NO: 1619 - DNA, 735 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttataagttcaagaaaaaggaatctttatacttcagataaagctgttcttgaacatttttttcgtcattatcttagttaacctg

SEQ ID NO: 1620 - DNA, 730 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacatttttttcgtcattatcttagttaaccg

SEQ ID NO: 1621 - DNA, 733 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttcgtcattatctagttaaccg

SEQ ID NO: 1622 - DNA, 770 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacaggcgtgaccgcagtggaggcagtgcatgcatggcgcaatgcactgacgggtgccccgctcaacttgaccccggagcaggtggtggccatcgccagccacgatggcggcaagcaggcgctggagacggtccagcggctgttgccggtgcttgcattcctcaattcttgtgccataccatggatggttagttcatcccggctttttgtttgtcattggaagttcttttattgattcaattttatagcgtgttcggaaacgcgtttcagaaaataatgaaatacatcttgatctgaaagttataactttagcttcattgtcattgaaaagttcttttattaattatattttattgcgtgtttggaatcccatttgagaaataagaaatcacgtttaaaatgtgaaagttataactattaacttttgactaaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatag

SEQ ID NO: 1623 - DNA, 712 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggatgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacattttttt

SEQ ID NO: 1624 - DNA, 727 bp, Artificial
  Glycine max FAD3A mutation created with TALEN pair GmFAD3_T02.1
  misc_feature (719): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacatacaatctgctctgatgccgcatagttaagccagccccgacacccgccatgcattcctcaattcttgtgccataccatggatggttagttcatcccggcttttttgttgtcattggaagttcttttattgattcaatttttatagcgtgttcggaaaacgcgtttcagaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaattcacattttgatgtggaaccaaatctgatttgagaaccaagttgattttgatggattttgcaggagaattagccacagaactcaccatcaaaattcatggacacattgagaaggatgaatcctgggttccagtatgtgattaactacttcctctatagttatttttgattcaattaaatttattttattttaataagttcaagaaaaaggaagaatcttttattacttcaganaaaagctg

SEQ ID NO: 1625 - DNA, 624 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaagtcatggacacattgagaaggatgaatcctgggttccagtatgtgattaacctacttcctctatag

SEQ ID NO: 1626 - DNA, 575 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggatttgcaggagaattagccacagaactcaccatcaaaatcatggacacattgg

SEQ ID NO: 1627 - DNA, 662 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacttgccggtgctgtgccaggcccacggcttgaccccacgacgaggtggtggccgtctccagcgcctgcttgccgccatcgtggctggcgatggtccagcggctgttgccggtgctgtgccaggcccacggcttgacccggagcaggtggtggccatcgccagcaattcctcaattcttgtgccataccatggatggttagttcatcccggcttttttgtttgtcattggaagttcttttattgattcaatttttatagcgtgttcggaaacgcgttcagaaaataatgaaatacatcttgaatctgaaagttataacttttagcttcattgtcattgaaagttcttttattaattatattttattgcgtgtttggaatcccatttgagaaataagaatcacgtttaaaatgtgaaagttataactattaacttttgactaaacttgaaaaatcacatttttgatgtggaaccaaatctgatttgagaaccaag

SEQ ID NO: 1628 - DNA, 726 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacatttttttcgtcattatct

SEQ ID NO: 1629 - DNA, 624 bp, Artificial
  Glycine max FAD3A mutation created with TALEN pair GmFAD3_T02.1
cactgctttgttaatgcctacctcatttcatttggctttagacaacttaaatttgagatctttattatgttttttgcttatatggtaaagtgattcattcttcacattgaattgaacagtggccatggaagcttttcagacagcccttttctaaatagcctggtggggcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaatgtgaaagttataactattaacttttgactaaacttgaaaaaattcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagtta

SEQ ID NO: 1630 - DNA, 492 bp, Artificial
  Glycine max FAD3A mutation created with TALEN pair GmFAD3_T02.1
  misc_feature (467): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggattcctcaattcttgtgccataccatggatggttagttcatcccggcttttttgtttgtcattggaagttcttttattgattcaattttatagcgtgttcggaaacgcgtttcagaaaataatgaaatacatcttgaatctgaaaagttataacttttagcttcattgtcattgaaaagttctttattaattatatttttattgcgtgtttggaatcccatttgagaaataagaaatcacgtttaaaatgtgaagttataactattaactttgactaaactgaaaaaattcacatttttgntgtggaaccaaatctgatttgagaa

SEQ ID NO: 1631 - DNA, 735 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtggcttgcattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaaatgtgaaagttataactattaacttttgactaaacttgaaaaaatcacattttgatgtggaaccaaatctgatttgagaaccaagttgattttgatggatttgcaggagaattagccacagaactcaccatcaaaatcatggacacattgagaaggatgaatcctgggttccagtatgtgattaactacttcctctatagttatttttgattcaattaaatttatttatttaataaagttcaagaaaaaatggaatctttatacttcagataaaagctgttcttgaacatttttttgtcattatctaagttaaccg

SEQ ID NO: 1632 - DNA, 437 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtggggcattcctcaattcttgtgccataccatggatggttagttcatcccggcttttttgtttgtcattggaagttcttttattgattcaattttatagcgtgttcggaaacgcgtttcagaaaataatgaaatacatcttgaatctgaaaagttataacttttagcttcattgtcattgaaagttcttttattaattatattttattgcgtgtttggaatcccatttgagaaataagaaatcacgtttaaaatgtgaaagttataactattaac

SEQ ID NO: 1633 - DNA, 611 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggatggttagttcatcccggcttttttgtttgtcattggaagttcttttattgattcaatttttatagcgtgttcggaaacgcgtttcagaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgattgagaaccaagttgattttgatggattttgcaggagaattagccacatgaactcaccatcaaaatcatggacacattgaagaaggatgaatcctgggttccagtatgtgattaactacttcctctatagttatttttgattcaattaaatttatttatttaataagttcaagaaaaaatggaatctttatac

SEQ ID NO: 1634 - DNA, 659 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaagttctttattaattatattttattgcgtgtttggaatcccatttgagaaataagaaatcacgtttaaaatgtgaaagttataactattaacttttgactaaacttgaaaaaattcacatttttgatgtggaaccaaatctgatttgagaaccaagttgattttgatggattttgcaggagaatttagccacagaactcaccatcaaaatcatggacacattgagaaggatgaatcctgggttccagtatgtgattaactacttcctctatagttattttgattcaattaaatttatttatttaataagttcaagaaaaaa

SEQ ID NO: 1635 - DNA, 731 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacattttttttgtcattatcttagttaaccg

SEQ ID NO: 1636 - DNA, 733 bp, Artificial
  Glycine max FAD3A mutation created with TALEN pair GmFAD3_T02.1
  misc_feature (679): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaatttatttatttaataagttcaagaaaaatggaatctttntacttcagataaagctgttcttgaacattttttttcgtcattatctagttaacc

SEQ ID NO: 1637 - DNA, 733 bp, Artificial
  Glycine max FAD3A mutation created with TALEN pair GmFAD3_T02.1
  misc_feature (678): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttntacttcagataaagctgttcttgaacattttttttcgtcattatctagttaaccg

SEQ ID NO: 1638 - DNA, 731 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaatgtgaagttataactattaacttttgactaaacttgaaaaaattcacatttttgatgtggaaccaaatctgattgagaaccaagttgattttgatggattttgcaggagaattagccacagaactcaccatcaaaatcatggacacattgagaaggatgaatcctgggttccagtatgtgattaactacttcctctatagttattttcgattcaattaaatttatttattaataagttcaagaaaaaagggaatctttatacttcagataaagctgttcttgaacatttttttagtcattatcttagttaaccgag

SEQ ID NO: 1639 - DNA, 732 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacgcattcctcaattcttgtgccataccatggatggttagttcatcccggcttttttgtttgtcattggaagttctttttattgattcaatttttatagcgtgttcggaaacgcgtttcaggaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacatttttttgtcattatctagttaaccg

SEQ ID NO: 1640 - DNA, 729 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtggttcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaatgtgaagttataactattaacttttgactaaacttgaaaaaatcacatttttgatgtggaaccaaatctgatttgagaaccaagttgattttgatggattttgcaggagaatttagccacagaactcaccatcaaaatcatggacacattgagaaggatgaatcctgggttccagtatgtgattaactacttcctctatagttattttgattcaattaaatttatttatttaataagttcaagaaaaaaggaatctttatacttcagataaagctgttcttgaacatttttttgtcattatcttagttaaccgag

SEQ ID NO: 1641 - DNA, 716 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacattttttt

SEQ ID NO: 1642 - DNA, 734 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaatttatttatttaataagttcaagaaaaatggaatctttatacttcagataaagctgttcttgaacatttttttcgtcattatctagttaacc

SEQ ID NO: 1643 - DNA, 733 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacatttttttcgtcattatctagttaaccg

SEQ ID NO: 1644 - DNA, 732 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacatttttttgtcattatctagttaaccg

SEQ ID NO: 1645 - DNA, 716 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggatttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttt

SEQ ID NO: 1646 - DNA, 714 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacattttttt

SEQ ID NO: 1647 - DNA, 625 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaataagaaatcacgtttaaaatgtgaaagttataactattaacttttgactaaacttgaaaaaattcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttt

SEQ ID NO: 1648 - DNA, 662 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatattttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttattaatagttcaagaaaaaggaatcttatacttca

SEQ ID NO: 1649 - DNA, 693 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggagcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgttttggaaatcccatttgagaaataagaaatcacgtttaaaatgtgaaagttataactattaacttttgactaaacttgaaaaaattcacatttttgatgtggaaccaaatctgaatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaagggaatctttatacttcagataaa

SEQ ID NO: 1650 - DNA, 747 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacctgctccggggtcaagccgtgggcctggcacagcaccggcaacagccgctggaccgtctgcattcctcaattcttgtgccataccatggatggttagttcatcccggcttttttgtttgtcattggaagttcttttattgattcaatttttatagcgtgttcggaaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaactttgactaaacttgaaaaaatcacattttgatgtggaaccaaatctgatttgagaaccaagttgaatttgatggattttgtcaggagaattagccacagaactcaccatcaaaatcatggacacattgagaaggatgaatcctgggttccagtatgtgattaactacttcctctatagttatttttgattcaattaaatttatttatttataagttcaagaaaaaagggaatctttatacttcagat

SEQ ID NO: 1651 - DNA, 732 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacagcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacattttttttcattatcttagttaaccg

SEQ ID NO: 1652 - DNA, 736 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacagcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttgtcattatctagttaaccg

SEQ ID NO: 1653 - DNA, 627 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtggggagctaagtagcaccgcctacattcctcaattcttgtgccataccatggatggttagttcatcccggctttttttgtttgtcattggaagttctttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgattgtggaaccaaatctgatttgagaaccaagtttgattttgatggattttgcaggagaattagccacagaactcaccatcaaaatcatggacacattgagaaggatgaatcctgggttccagtatgtgattaa

SEQ ID NO: 1654 - DNA, 732 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcatctctcatgattgaatacagtggccatggaagcttttcagacagcccttttctaaatagcctggtgggacacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttcgtcattatctagttaaccg

SEQ ID NO: 1655 - DNA, 725 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacgcattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttattttatttaataaagttcaagaaaaatggaatctttatacttcagataaagctgttcttgaacattttttttgtcattatct

SEQ ID NO: 1656 - DNA, 726 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttgtcattatct

SEQ ID NO: 1657 - DNA, 712 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacattcctcaattcttgtgccataccatggatggttagttcatccaggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacattttttt

SEQ ID NO: 1658 - DNA, 702 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaaggaatctttatacttcagataaagctgttcttgaacattttttt

SEQ ID NO: 1659 - DNA, 732 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggagcattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaaggaatctttatacttcagataaagctgttcttgaacattttttttgtcattatcttagttaaccg

SEQ ID NO: 1660 - DNA, 584 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgttataacttttagcttcattgtcattgaaagttcttttattaattatatttttattgcgtgtttggaatcccatttgagaaataagaaatcacgtttaaaatgtgaaagttataactattaacttttgactaaaacttgaaaaaactcacatttttgatgtggaaccaaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaaggaatctttatacttcagataaagctgttcttgaacatttttttgtcattatcttagttaaccgag

SEQ ID NO: 1661 - DNA, 734 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacattttttttcgtcattatcttagttaaccg

SEQ ID NO: 1662 - DNA, 718 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacactgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggatttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacatttttttgtca

SEQ ID NO: 1663 - DNA, 733 bp, Artificial; identical to SEQ ID NO: 1434
  Glycine max FAD3A mutation created with TALEN pair GmFAD3_T02.1

SEQ ID NO: 1664 - DNA, 734 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacttcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacattttttttcgtcattatcttagttaaccg

SEQ ID NO: 1665 - DNA, 593 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataactttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgattgagaaccaagttgattttgatggattttgcaggagaattagccacagaactcaccatcaaaatcatggacacattgagaaggatgaatcctgggttcc

SEQ ID NO: 1666 - DNA, 589 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcggtttgcgtattgggcgctcttccgcttcctcgctcactgactcgctgcgctccctcgtgcgctctcctgttccgaccctgccgcttaccggatacctgtccgccttgcattcctcaattcttgtgccataccatggatggttagttcatcccggctttttgtttgtcattggaagttcttttattgattcaatttttatagcgtgttcggaaaacgcgtttcagaaaataatgaatacatcttgaatctgaaagttataacttttagcttcattgtcattgaaagttcttttattaattatatttttattgcgtgtttggaatcccatttgagaaataagaaatcacgttaaaatgtgaaagttataactattaacttttgactaaaatcttgaaaaaaactcacatttttgtgt

SEQ ID NO: 1667 - DNA, 733 bp, Artificial
  Glycine max FAD3A mutation created with TALEN pair GmFAD3_T02.1
  misc_feature (175): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacagctntcctccattcattgtgcatcacactgatggattgatgtgtcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaaatctttatacttcagataaagctgttcttgaacattttttttgtcattatct

SEQ ID NO: 1668 - DNA, 495 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggggggtcaagccgtgggcctggcacagcaccggcaacagccgctggaccgtctccagcgccttgcattcctcaattcttgtgccataccatggatggttagttcatcccggcttttttgtttgtcattggaagttcttttattgattcaatttttatagcgtgttcggaaaacgcgtttcagaaaataatgaaatacatcttgaatctgaaagttataacttttagcttcattgtcattgaaagttctttataattatatttttattgcgtgtttggaatcccatttgagaaataagaaatcacgtttaaaatgtgaaagttataactattaac

SEQ ID NO: 1669 - DNA, 733 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacaattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacatttttttcgtcattatctagttaacc

SEQ ID NO: 1670 - DNA, 727 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggatttgcaggagaattagccacagaactcaccatcaaaatcatggacacattgagaaggatgaatcctgggttccagtatgtgattaactacttcctctatagttatttttgattcaattaaatttatttatttaataaagtttcaagaaaaaaggaatctttatacttcagataaagctgttcttgaacatttttttgtcattatctt

SEQ ID NO: 1671 - DNA, 727 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggaccattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttattttatttaataagttcaagaaaaaggaatctttatacttcagataaagctgttcttgaacattttttttgtcattatcttag

SEQ ID NO: 1672 - DNA, 604 bp, Artificial
  Glycine max FAD3A mutation created with TALEN pair GmFAD3_T02.1
  misc_feature (395): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaaagttataaacttttagtcttcattgtcattgaaagttacttttcattaattatattttattgcgtgtttggaatcccnttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtga

SEQ ID NO: 1673 - DNA, 734 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacaattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaaggaatctttatacttcagataaagctgttcttgaacattttttttcgtcattatcttagttaaccg

SEQ ID NO: 1674 - DNA, 673 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtggggcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaagggaatc

SEQ ID NO: 1675 - DNA, 737 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacattttttttcgtcattatcttagttaaccg

SEQ ID NO: 1676 - DNA, 696 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttcttttattaattatatttttattgcgtgtttggaatcccatttgagaaataagaaatcacgtttaaaatgtgaagttataactattaacttttgactaaacttgaaaaaatcacattttgatgtggaaccaaatctgatttgagaaccaagttgattttgatggattttgcaggagaattagccacagaactcaccatcaaaaatcatggacacattgagaaggatgaatcctgggttccagtatgtgattaactacttcctctatagttatttttgattcaattaaatttatttatttaataagttcaagaaaaaaggaatctttatacttcagataaagctgttcttgaacattttttttgtcattatcttagttaaccgag

SEQ ID NO: 1677 - DNA, 724 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacatttttttgtcattatct

SEQ ID NO: 1678 - DNA, 712 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaaatgtgaaagttataactattaacttttgactaaacttgaaaaaattcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaagggaatctttatacttcagataaagctgttcttgaacattttttt

SEQ ID NO: 1679 - DNA, 737 bp, Artificial
  Glycine max FAD3A mutation created with TALEN pair GmFAD3_T02.1
  misc_feature (683): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttntacttcagataaagctgttcttgaacattttttttgtcattatctagttaaccg

SEQ ID NO: 1680 - DNA, 723 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacattcctcaattcttgtgccataccatggatgtttagttcatcccggcttttttgtttgtcattggaagttcttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttcgtcattatc

SEQ ID NO: 1681 - DNA, 659 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaaatcatttatgttttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaaacttgaaaaaatcacatttttgatgtggaaccaaattctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttattatttaataagttcaagaaaaatggaatctttatacttcagataaagctgttcttgaacattttttttagtcattattcttagttaaccgagaatg

SEQ ID NO: 1682 - DNA, 730 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaaggaatctttatacttcagataaagctgttcttgaacatttttttgtcattatcttagttaaccg

SEQ ID NO: 1683 - DNA, 656 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaaatcatttatgttttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaatggatctttatacttcagataaagctgttcttgaacattttttttgtcattattcttagttaaccgagaatg

SEQ ID NO: 1684 - DNA, 734 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacaagcattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacatttttttcgtcattatctagttaaccg

SEQ ID NO: 1685 - DNA, 689 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctgggcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaatgttgattttgatggattttgcaggagaatttagccacagaactcaccatcaaaatcatggacacattgagaaggatgaatcctgggttccagtatgtgattaactacttcctctatagttattttgattcaattaaatttattatttaataagttcaagaaaaaaggaatctttatacttcagataaagc

SEQ ID NO: 1686 - DNA, 735 bp, Artificial
  Glycine max FAD3A mutation created with TALEN pair GmFAD3_T02.1
  misc_feature (682): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacagcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaaactcaccatcaaaatcatggacacattgagaaggatgaatcctgggttccagtatgtgattaactacttcctctatagttatttttgattcaattaaatttatttatttaataagttcaagaaaaatggaatctttntacttcagataaagctgttcttgaacatttttttgtcattatctagttaaccg

SEQ ID NO: 1687 - DNA, 736 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttcgtcattatctagttaaccg

SEQ ID NO: 1688 - DNA, 732 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaaggaatctttatacttcagataaagctgttcttgaacattttttttgtcattatcttagttaacc

SEQ ID NO: 1689 - DNA, 718 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacatttttttt

SEQ ID NO: 1690 - DNA, 646 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggcggctccaggaagcccgacggcgccatctacaccgtgggctcccccatcgactacggcgtgatcgtggacaccaaggcctactccggcggctacaacctgcccatcggccaggccgacgaagcattcctcaattcttgtgccataccatggatggttagttcatcccggctttttgtttgtcattggaagttcttttattgattcaatttttatagcgtgttcggaaacgcgtcatcgaaaataatgaaatacatcttgaatctgaaagttataacttttagcttcattgtcattgaaagttcttttattaattatatttttattgcgtgttggaatcccatttgagaaataagaaatcacgtttaaaatgtgaaagttataactattaactttgactaaacttgaaaaaagtcacatttttgatgtggaaccaaatctgatttgagaaccaagtttgattttgatggattttgcaggag

SEQ ID NO: 1691 - DNA, 734 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtggcttgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaaggaatctttatacttcagataaagctgttcttgaacattttttttgtcattatcttagttaaccg

SEQ ID NO: 1692 - DNA, 731 bp, Artificial
  Glycine max FAD3A mutation created with TALEN pair GmFAD3_T02.1
  misc_feature (677): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacatattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaatggaatctttntacttcagataaagctgttcttgaacattttttttgtcattatctagttaaccg

SEQ ID NO: 1693 - DNA, 736 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttcgtcattatcttagttaaccg

SEQ ID NO: 1694 - DNA, 739 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtggggcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaatttagccacagaactcaccatcaaaatcatggacacattgagaaggatgaatcctgggttccagtatgtgattaactacttcctctatatgttattttgattcaatttaaatttatttatttaataatgttcaagaaaaaaagggaatctttatacttcagataaagctgttcttgaacatttttttgtcattatcttagttaaccgag

SEQ ID NO: 1695 - DNA, 733 bp, Artificial
  Glycine max FAD3A mutation created with TALEN pair GmFAD3_T02.1
  misc_feature (678): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacgcattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttntacttcagataaagctgttcttgaacattttttttcgtcattatctagttaaccg

SEQ ID NO: 1696 - DNA, 732 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacattttttttcgtcattatcttagttaacc

SEQ ID NO: 1697 - DNA, 703 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaataccatggatggttagttcatcccggcttttttgtttgtcattgggaagttcttttattgattcaatttttatagcgtgttcggaaacgcgtttcagaaaataatgaaatacatcttgaatctgaaagttataacttttagcttcattgtcattgaaaagttcttttattaattatatttttattgcgtgtttggaatcccatttgagaaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaaatcatggacacattgagaaggatgaatcctgggttccagtatgtgattaactacttcctctatagttatttttgattcaattaaaatttattatttaataagttcaagaaaaaaaggaatctttatacttcagataaagctgttcttgaacattttttttgtcattatcttagttaaccgag

SEQ ID NO: 1698 - DNA, 733 bp, Artificial; identical to SEQ ID NO: 1468
  Glycine max FAD3A mutation created with TALEN pair GmFAD3_T02.1

SEQ ID NO: 1699 - DNA, 736 bp, Artificial
  Glycine max FAD3A mutation created with TALEN pair GmFAD3_T02.1
  misc_feature (682): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacatgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttataagttcaagaaaaatggaatctttntacttcagataaagctgttcttgaacattttttttcgtcattatctagttaacc

SEQ ID NO: 1700 - DNA, 690 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggactcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaaggaatctttatacttcagataaagc

SEQ ID NO: 1701 - DNA, 714 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacattcctcaattcttgtgccataccatggatggttagttcatcccggcttttttgtttgtcattggaagttctttttattgatttaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaatttatttatttaataagttcaagaaaaaggaatctttatacttcagataaagctgttcttgaacattttttttgtca

SEQ ID NO: 1702 - DNA, 734 bp, Artificial
  Glycine max FAD3A mutation created with TALEN pair GmFAD3_T02.1
  misc_feature (680): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttntacttcagataaagctgttcttgaacatttttttcgtcattatctagttaaccg

SEQ ID NO: 1703 - DNA, 737 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacttgcattcctcaattcttgtgccataccatggatggttagttcatcccggcttttttgtttgtcattggaagttcttttattgattcaatttttatagcgtgttcggaaatgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacattttttttgtcattatcttagttaaccg

SEQ ID NO: 1704 - DNA, 471 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaatgtgaaagttataactattaacttttgactaaacttgaaaaaatcacatttttgatg

SEQ ID NO: 1705 - DNA, 755 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgagaagttggcctgtgtccaactgtaacggtggacctctcaactctcccgccaccgtgagcaagtgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaatcacattttgatgtggaaccaaatctgatttgagaaccaagttgattttgatggattttgcaggagaattagccacagaactcaccatcaaaatcatggacacattgagaagggatgaatcctgggttccagtatgtgattaactacttcctctatagttattttttgattcaattaaattttatttatttaataagttcaagaaaaaggaatctttatac

SEQ ID NO: 1706 - DNA, 730 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacagcgcctgcttgccgccatcgtggctggcgatggccaccacctgctccggggtcaagccgtgggcctggcacagcaccggcaacagccgctggattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatattttattgcgtgtttggaatcccatttgagaaataagaaatcacgtttaaaatgtgaaagttataactattaacttttgactaaacttgaaaaaatcacatttttgatgtggaaaccaaatctgatttgagaaccaagttgattttgatggattttgcaggagaattagccacagaactcaccatcaaaatcatggacacattgagaagggatgaatcctgggttccagtatgtgattaactacttcctctatagttatttttgattcaatt

SEQ ID NO: 1707 - DNA, 673 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggagcattcctcaattcttgtgccataccatggatggttagttcatcccggcttttttgtttgtcattggaagttcttttattgaattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactaacttcctctatagttatttttgattcaattaaatttattttatttaataagttcaagaaaaaggaa

SEQ ID NO: 1708 - DNA, 693 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaaggaatctttatacttcagataaagctg

SEQ ID NO: 1709 - DNA, 638 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacagccgctggaccgtctccagcgcctgcttgccaccattattgctggcgatggccaccacctgctggggggtcaagccgtgggcctggcacagcaccggcaacagccgctggacttgcattcctcaattcttgtgccataccatggatggttagttcatcccggctttttgtttgtcattggaagttcttttattgattcaatttttatagcgtgttcggaaacgcgtttcagaaataatgaaatacatcttgaatctgaaagttataacttttagcttcattgtcattgaaagttcttttattaattatattttattgcgtgtttggaatcccatttgagaaataagaaatcacgtttaaaatgtgaaagttataactattaactttgactaaacttgaaaaagtcacatttttgatgtggaaccaaatctgattgagaaccaagttgattttgatggattttgcaggag

SEQ ID NO: 1710 - DNA, 643 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaattattt

SEQ ID NO: 1711 - DNA, 419 bp, Artificial
  Glycine max FAD3A mutation created with TALEN pair GmFAD3_T02.1
actgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacactgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaaagttcttttattaattatatttttattgcgtgtttggaatcccatttgagaaataagaaatcacgttt

SEQ ID NO: 1712 - DNA, 734 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacatgcattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttattttatttaataagttcaagaaaaatggaatctttatacttcagataaagctgttcttgaacatttttttgtcattatctagttaaccg

SEQ ID NO: 1713 - DNA, 735 bp, Artificial
  Glycine max FAD3A mutation created with TALEN pair GmFAD3_T02.1
  misc_feature (681): n is a or c or t or g
actgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacactgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttntacttcagataaagctgttcttgaacattttttttgtcattatctagttaaccg

SEQ ID NO: 1714 - DNA, 736 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacagcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttcgtcattatctagttaaccg

SEQ ID NO: 1715 - DNA, 714 bp, Artificial
  Glycine max FAD3A mutation created with TALEN pair GmFAD3_T02.1
  misc_feature (174): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacactgcntcctcaattcattgtgcataccactgatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaattatttatttaataagttcaagaaaaaggaatctttatacttcagataaagctgttcttgaacatttttttt

SEQ ID NO: 1716 - DNA, 732 bp, Artificial; identical to SEQ ID NO: 1644
  Glycine max FAD3A mutation created with TALEN pair GmFAD3_T02.1

SEQ ID NO: 1717 - DNA, 635 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggatttgcaggagaattagccacagaactcaccatcaaaatcatggacacattgagaaggatgaatcctgggttccagtatgtgattaactacttcctctatagtattttgattcaa

SEQ ID NO: 1718 - DNA, 732 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggagcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacattttttttgtcattatcttagttaaccg

SEQ ID NO: 1719 - DNA, 734 bp, Artificial
  Glycine max FAD3A mutation created with TALEN pair GmFAD3_T02.1
  misc_feature (680): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacagcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttntacttcagataaagctgttcttgaacattttttttgtcattatctagttaaccg

SEQ ID NO: 1720 - DNA, 633 bp, Artificial
  Glycine max FAD3A mutation created with TALEN pair GmFAD3_T02.1
  misc_feature (494); (608): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtggcattcctcaattcttgtgccataccatggatggttagttcatcccggcttttttagtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaaactgtgaagttataacttattaactttgactaaactgaaaaaattcacatttttagatgtggaaccaaatctgattnagaaccagttgattttgatggattttggcaggagaattaagccacagaaactcaccatcaaaattcatggacacattgagaaggatgaatcctgggttccagtatgtgattaantacttcctctatagttatttttcga

SEQ ID NO: 1721 - DNA, 737 bp, Artificial
  Glycine max FAD3A mutation created with TALEN pair GmFAD3_T02.1
  misc_feature (682): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacattgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttntacttcagataaagctgttcttgaacattttttttcgtcattatctagttaaccg

SEQ ID NO: 1722 - DNA, 592 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtggcttgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaaacttgaaaaaaactcacattttgatgtggaaccaaatctgatttgagaaccaagttgattttgatggattttgcaggagaattagccacagaactcaccatcaaaagtcatggacacattgagaaggatgaatcctggg

SEQ ID NO: 1723 - DNA, 603 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggattgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtga

SEQ ID NO: 1724 - DNA, 555 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacaattcctcaattcttgtgccataccatggatggttagttcatcccggcttttttgtttgtcattggaagttctttttattgaattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaaatcacgtttaaaaatgtgaaagttataagctattaacttttgactaaaacttgaaaaaatcaacattttgatgtggaaccaaatctgatttgagaaccaagttgattttgatggattttgcaggagaattagccacagaaactc

SEQ ID NO: 1725 - DNA, 734 bp, Artificial
  Glycine max FAD3A mutation created with TALEN pair GmFAD3_T02.1
  misc_feature (680): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacagcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttataagttcaagaaaaatggaatctttntacttcagataaagctgttcttgaacattttttttcgtcattatctagttaacc

SEQ ID NO: 1726 - DNA, 737 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacatgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttattttatttaataagttcaagaaaaaggaatctttatacttcagataaagctgttcttgaacattttttttcgtcattatcttagttaacc

SEQ ID NO: 1727 - DNA, 723 bp, Artificial
  Glycine max FAD3A mutation created with TALEN pair GmFAD3_T02.1
  misc_feature (679): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacaagcattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttataagttcaagaaaatggaatctttntacttcagataaagctgttcttgaacatttttttcgtcattatc

SEQ ID NO: 1728 - DNA, 726 bp, Artificial; identical to SEQ ID NO: 1506
  Glycine max FAD3A mutation created with TALEN pair GmFAD3_T02.1

SEQ ID NO: 1729 - DNA, 734 bp, Artificial; identical to SEQ ID NO: 1546
  Glycine max FAD3A mutation created with TALEN pair GmFAD3_T02.1

SEQ ID NO: 1730 - DNA, 651 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaaatcatttatgttttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaatggaatctttatacttcagataaagctgttcttgaacattttttttgtcattattcttagttaacc

SEQ ID NO: 1731 - DNA, 658 bp, Artificial
  Glycine max FAD3A mutation created with TALEN pair GmFAD3_T02.1
actgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacactgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaaactcaccatcaaaatcatggacacattgagaaggatgaaatcctgggttccagtatgtgattaactacttcctctatagttatttttgattcaattaaatttatttatttaat

SEQ ID NO: 1732 - DNA, 736 bp, Artificial
  Glycine max FAD3A mutation created with TALEN pair GmFAD3_T02.1
  misc_feature (684): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaagtcatggacacattgagaaggatgaatcctgggttccagtatgtgattaactacttcctctatagttatttttgattcaattaaatttatttcatttaataagttcaagaaaaatggaatctttntacttcagataaagctgttcttgaacattttttttcgtcattatctagttaa

SEQ ID NO: 1733 - DNA, 735 bp, Artificial
  Glycine max FAD3A mutation created with TALEN pair GmFAD3_T02.1
  misc_feature (680): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggattgcattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttntacttcagataaagctgttcttgaacattttttttcgtcattatctagttaaccg

SEQ ID NO: 1734 - DNA, 735 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggaattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaatgtgaaagttataactattaacttttgactaaacttgaaaaaattcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaaggaatctttatacttcagataaagctgttcttgaacattttttttagtcattatcttagttaaccgag

SEQ ID NO: 1735 - DNA, 659 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttcacattgagatctttattatgttttttgtttgtcattggaagttcttttattgattcaatttttatagcgtgttcggaaacgcgtttcagaaataatgaaatacatcttgaatctgaaagttataacttttagcttcattgtcattgaaaagttcttttattaattatatttttattgcgtgtttggaatcccatttgagaaataagaaatcacgtttaaaatgtgaagttataactattaacttttgactaaacttgaaaaaatcacattttgatgtggaaccaaatctgatttgagaaccaagttgattttgatggatttttgcaggagaattagccacagaacttcacaaatcaatgatgcacattgagaaggatgaatcctgggttccagtattgattaactacttcctctatagttatttttgattcaattaaatttattattaataagttcaagaaaaaggaatctttatacttcagataaagctgttacttgaactatttttttt

SEQ ID NO: 1736 - DNA, 479 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcccttttcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaattgtgaaagttataactattaacttttgactaaacttgaaaaaactcacatttttgatgtggaaccaaa

SEQ ID NO: 1737 - DNA, 759 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtggggtggtggccatcgccagcaatattggtggaactgaaaatggagtgcacatcacaaagattgaatcctcctcaattcttgtgccataccatggatggttagttcatcccggcttttttgtttgtcattggaagttcttttattgattcaatttttatagcgtgttcggaaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggtttccagtatgtgattaactacttcctctatagttatttttgattcaattaaatttatttatttataagttcaagaaaaaagggaatctttatacttcagataaagctgttc

SEQ ID NO: 1738 - DNA, 738 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcttgcattcctcaattcttgtgccataccatggatggttagttcatcccggcttttttgtttgtcattggaagttcttttatgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttgtcattatctagttaaccg

SEQ ID NO: 1739 - DNA, 647 bp, Artificial
  Glycine max FAD3A mutation created with TALEN pair GmFAD3_T02.1
  misc_feature (396): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaattcggcttttttgtttgtcattggaagttcttttattgattcaatttttatagcgtgttcggaaacgcgtttcagaaaattaatgaaatacatcttgaatctgaaaggttataacttttagcttcattgtcattgaaaagttcttttattaattatatttttattgcgtgttttggaatccatttgagaaataagaaatcacgtttaaaattgtgaaatgttataactattaacttttgacnaaacttgaaaaaattcacatttttgatgtggaaccaaattctgatttgagaaccaagttgattttgatggattttgcaggagaattagccacagaactcaccatcaaaaagtcatggacacattgagaaggatgaatcctgggttccagtatgtgattaactacttcctctatagttattttgattcaattaaatttattatttaataagttcaagaaaaatggaatctttatacttcagataaagctgtt

SEQ ID NO: 1740 - DNA, 731 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagccttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaataagaaatcacgtttaaaatgtgaagttataactattaacttttgactaaacttgaaaaaatcacatttttgatgtggaaccaaatctgatttgagaaccaagttgattttgatggattttgcaggagaatttagccacagaactcaccatcaaaatcatggacacattgagaaggatgaatcctgggttccagtatgtgattaactacttcctctatagttattttgattcaattaaatttatttatttaataagttcaagaaaaaaggaatctttatacttcagataaagctgattcttgaacatttttttgtcattatcttagttaaccgagaag

SEQ ID NO: 1741 - DNA, 737 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacagcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttattttatttaataagttcaagaaaaatggaatctttatacttcagataaagctgttcttgaacattttttttcgtcattatctagttaaccg

SEQ ID NO: 1742 - DNA, 734 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacagcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacatttttttgtcattatctaagttaaccg

SEQ ID NO: 1743 - DNA, 602 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacactattgctggcgatggccaccacctgctccggggtcaagccgtgggcctggcacagcaccggcaacagcgcctggaccgtctccagcgcctgcttgccaccaactcaattcttgtgccataccatggatggttagttcatcccggctttttgtttgtcattggaagttcttttattgattcaatttttatagcgtgttcggaaacgcgtttcagaaaataatgaaatacatcttgaatctgaaagttataacttttagcttcattgtcattgaaaagttcttttattaattatattttattgcgtgtttggaatcccatttgagaaataagaaatcacgtttaaaatgtgaaagttataactattaactttgactaaacttgaaaaaatcacattttgatgtggaaaccaaatctgatttgagaaccaagttg

SEQ ID NO: 1744 - DNA, 701 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggactgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttc

SEQ ID NO: 1745 - DNA, 739 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttattttaaataagtttcaagaaaaaatggaatctttataattcagataaagctgttctttgaacattttttttgtcattatctagttaaccg

SEQ ID NO: 1746 - DNA, 747 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtggtggccatcgccagcaatggcggtggcaagcaggcgctggagacggtccagcggctgttgccggtgctggcgatggccaccacctgctccggggtcaagccgtgggccatcattcctcaattcttgtgccataccatggatggttagttcatcccggctttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatattttattgcgtgttggaatcccatttgagaaataagaatcacgtttaaaatgtgaaagttataactattaactttgactaaacttgaaaaaatcacatttttgatgtggaaccaaatctgatttgagaaccaagttgattttgatggattttgcaggagaattagccacagaactcaccatcaaaatcatggacacattgagaagggatgaatcctgggttccagtatgtgattaactacttcctctatagttatttttgattcaattaatttattta

SEQ ID NO: 1747 - DNA, 612 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaatgtgaaagttataactattaacttttgactaaacttgaaaaaattcacatttttgatgttggaaccaaatctgaatttgagaaccaatgttgattttgatggattttgcaggagaatttagccacagaacttcatccatcaaaatcatggacacattgagaaggatgaatcctgggttccaagtatgtgattaact

SEQ ID NO: 1748 - DNA, 608 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaactcacattttgatgtggaaccaaatctgatttgagaaccaagttgattttgatggatttgcaggagaattagccacagaactcaccatcaaaatcatggacacattgagaaggatgaatcctgggttccagtatgtgattaa

SEQ ID NO: 1749 - DNA, 736 bp, Artificial
  Glycine max FAD3A mutation created with TALEN pair GmFAD3_T02.1
  misc_feature (680): n is a or c or t or g
cactgctttgttatccctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttataagttcaagaaaaatggaatctttntacttcagataaagctgttcttgaacattttttttcgtcattatctagttaaccga

SEQ ID NO: 1750 - DNA, 714 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaagttataactattaacttttgactaaacttgaaaaaactcacattttgatgtggaaccaaatctgatttgagaaccaagttgattttgatggattttgcaggagaattagccacagaactcaccatcaaaagtcatggacacattgagaaggatgaatcctgggttccagtatgtgattaacctacttcctctatagttatttttcgattcaattaatttatttatttataagttcaagaaaatggaatctttatacttcagataaagctgttctgaacattttttttc

SEQ ID NO: 1751 - DNA, 733 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaaggaatctttatacttcagataaagctgttcttgaacattttttttcgtcattatcttagttaaccg

SEQ ID NO: 1752 - DNA, 730 bp, Artificial
  Glycine max FAD3A mutation created with TALEN pair GmFAD3_T02.1
  misc_feature (645); (676): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggatgcattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaattatttntttaataagttcaagaaaaatggaatctttntacttcagtaaagctgttcttgaacattttttttgtcattatcttagttaaccg

SEQ ID NO: 1753 - DNA, 741 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttaattttatttaattaagttcaagaaaaataggaaatctttataacttcagataaagctgttcttgaacatttttttcgtcattatctagttaaccg

SEQ ID NO: 1754 - DNA, 697 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggagcgcagcgagtcagtgagcgaggaagcggaagagcgcccaatacgcaaaccgcctcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaatcatcattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaa

SEQ ID NO: 1755 - DNA, 713 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacagcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacattttttt

SEQ ID NO: 1756 - DNA, 711 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtggggcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaataagaaatcacgtttaaaatgtgaaagttataactattaacttttgactaaacttgaaaaaattcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacattttttt

SEQ ID NO: 1757 - DNA, 737 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttgtcattatctagttaaccg

SEQ ID NO: 1758 - DNA, 652 bp, Artificial
  Glycine max FAD3A mutation created with TALEN pair GmFAD3_T02.1
cactgctttgttattcctacctcatttcatttggctttagacaacttaaatttgagatctttattatgttttttgcttatatggtaaaattcatttatgttttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaagtcacatttttgatgtggaaccaaattctgattttgagaacccaagttgattttgatggattttgcaggagaatttagccacagaactcaccatcaaaatcatggacacattgagaagggatgaatcctgggttccagtatgtgattaactacttcctctatagttatttttcgattccaattaaaattttattatttaattaagttcaagaaaaaatggaatctttatacttcagataaagctgttcttgaacattttttttagtcattat

SEQ ID NO: 1759 - DNA, 621 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacaggccaacttctcaagattgcaaaacgtggcggcgtgaccgcagtggaggcagtgcatgcatggcgcaatgcactgacgggtgccccgctcaacttgcattcctcaattcttgtgccataccatggatggttagttcatcccggctttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatattttattgcgtgttggaatcccatttgagaaataagaatcacgtttaaatgtgaaagttataactattaactttgactaaacttgaaaaaagtcacatttttgatgtggaaccaaatctgatttgagaaccaagttgattttgatggattttgcaggag

SEQ ID NO: 1760 - DNA, 735 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttcgtcattatctagttaacc

SEQ ID NO: 1761 - DNA, 672 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaaatgtgaaaagttataactattaacttttgactaaacttgaaaaaatcacatttttgatgtggaaccaaatctgattgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaaatggaatctttatacttcagataaaagctgttcttgaacattttttttgtcattatcttagtttaaccgagaag

SEQ ID NO: 1762 - DNA, 704 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacattgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttg

SEQ ID NO: 1763 - DNA, 411 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttggaatagaaatcaa

SEQ ID NO: 1764 - DNA, 733 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacattttttttgtcattatcttagttaaccg

SEQ ID NO: 1765 - DNA, 734 bp, Artificial
  Glycine max FAD3A mutation created with TALEN pair GmFAD3_T02.1
  misc_feature (679): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacgcattcctcaattcttgtgccataccatggatggttagttcatcccggcttttttgtttgtcattggaagttctttttattgattcaatttttatagcgtgttcggaaacgcgtttcaggaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttntacttcagataaagctgttcttgaacattttttttcgtcattatctagttaaccg

SEQ ID NO: 1766 - DNA, 736 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacatttttttcgtcattatctagttaacc

SEQ ID NO: 1767 - DNA, 737 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacagcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttccattatcttagttaaccg

SEQ ID NO: 1768 - DNA, 727 bp, Artificial
  Glycine max FAD3A mutation created with TALEN pair GmFAD3_T02.1
  misc_feature (691): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttattttatttaataagttcaagaaaaatggaatctttatacttcaganaaagctgttcttgaacattttttttcgtcattatct

SEQ ID NO: 1769 - DNA, 719 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatattttattgcgtgtttggaatcccatttgagaaataagaaatcacgtttaaaattgtgaaagttataactattaacttttgactaaacttgaaaaaatcacatttttgatgtggaaccaaatctgattttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaagggaatctttatacttcagataaagctgttcttgaacattttttttagtcattatcttagttaaccgag

SEQ ID NO: 1770 - DNA, 716 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatattttattgcgtgtttggaatcccatttgagaataagaaatcacgtttaaaattgtgaaagttataactattaacttttgactaaacttgaaaaaactcacatttttgatgtggaaccaaatctgattttgagaaccaagttgattttgatggattttgcaggagaattagccacagaactcaccatcaaaatcatggacacattgagaaggatgaatcctgggttccagtatgtgattaactacttcctctatagttatttttggattccaattaaatttatttatttaataagttcaagaaaaagggaatctttatacttcagataaagctgttcttgaacatttttttagtcattatcttagttaaccgag

SEQ ID NO: 1771 - DNA, 741 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttcgtcattatctagttaaccgagaa

SEQ ID NO: 1772 - DNA, 739 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggactgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttctttgaacattttttttgtcattatctagttaaccgagaa

SEQ ID NO: 1773 - DNA, 736 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggtcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaaatgtgaaagttataactattaacttttgactaaacttgaaaaaattcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaaagggaatctttatacttcagataaagctgttcttgaacattttttttagtcattatcttagttaaccgag

SEQ ID NO: 1774 - DNA, 732 bp, Artificial
  Glycine max FAD3A mutation created with TALEN pair GmFAD3_T02.1
  misc_feature (677): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggagcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttataagttcaagaaaaatggaatctttntacttcagataaagctgttcttgaacattttttttcgtcattatctagttaaccg

SEQ ID NO: 1775 - DNA, 680 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttcttttattaattatatttttaattgcgtgtttggaatcccatttgagaaataagaaatcacgtttaaaattgtgaaagttataactattaacttttgactaaacttgaaaaaatcacattttgatgtggaaccaaatctgatttgagaaccaagttgattttgatggattttgcaggagaattagccacagaactcaccatcaaaaatcatggacacattgagaaggatgaatcctgggttccagtatgtgattaactacttcctctatagttattttgattcaattaaaatttatttatttaataagttcaagaaaaaagggaatctttatacttcagataaagctgttcttgaacattttttttag

SEQ ID NO: 1776 - DNA, 736 bp, Artificial; identical to SEQ ID NO: 1714
  Glycine max FAD3A mutation created with TALEN pair GmFAD3_T02.1

SEQ ID NO: 1777 - DNA, 733 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttattttatttaataagttcaagaaaaaaggaatctttatacttcagataaagctgttcttgaacattttttttgtcattatcttagttaaccg

SEQ ID NO: 1778 - DNA, 742 bp, Artificial
  Glycine max FAD3A mutation created with TALEN pair GmFAD3_T02.1
  misc_feature (175): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacactgctntcctccattcattgtgcatcaccactgatggattgatgtgtcatccccggctttttttgtttgtcattggaagttcttttattgattcaatttttatagcgtgttcggaaacgcgtttcagaaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttgtcattatctagttaaccg

SEQ ID NO: 1779 - DNA, 699 bp, Artificial
  Glycine max FAD3A mutation created with TALEN pair GmFAD3_T02.1
cactgctttgttaatgcctacctcatttcatttggctttagacaacttaaatttgagatctttattatgttttttgcttatatggtaaagtgattcattcttcacattgaattgaacagtggccatggaagcttttcagacagcccttttctaaatagcctggtggggcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaatttagccacagaactcaccatcaaaatcatggacacattgagaaggatgaatcctgggttccagtatgtgattaactacttcctctatagttattttgattcaattaaatttatttatttaataagttcaagaaaaaagggaatctttatacttcagataaagctgtt

SEQ ID NO: 1780 - DNA, 734 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacagcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggatttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacatttttttgtcattatctagttaaccg

SEQ ID NO: 1781 - DNA, 733 bp, Artificial; identical to SEQ ID NO: 1580
  Glycine max FAD3A mutation created with TALEN pair GmFAD3_T02.1

SEQ ID NO: 1782 - DNA, 711 bp, Artificial
  Glycine max FAD3A mutation created with TALEN pair GmFAD3_T02.1
  misc_feature (170): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggactncattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagtatttttgattcaattaaatttatttatttataagttcaagaaaaatggaatctttatacttcagataaagctgttctgaacattttttt

SEQ ID NO: 1783 - DNA, 734 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacttcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttattttatttaataagttcaagaaaaaaggaatctttatacttcagataaagctgttcttgaacattttttttgtcattatcttagttaaccg

SEQ ID NO: 1784 - DNA, 734 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttattttatttaataagttcaagaaaaaaggaatctttatacttcagataaagctgttcttgaacattttttttcgtcattatcttagttaaccg

SEQ ID NO: 1785 - DNA, 615 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatattatcccgtattgacgccgggcaagagcaactcggtcgccgcatacactattctcagaatgacttggttgagtactccattcctcaattcttgtgccataccatggatggttagttcatcccggctttttgtttgtcattggaagttcttttattgattcaattttatagcgtgttcggaaacgcgtttcagaaataatgaaatacatcttgaatctgaaagttataactttagcttcattgtcattgaaagttcttttattaattatatttttattgcgtgtttggaatcccatttgagaataagaaatcacgtttaaaatgtgaaagttataatctattaacttttgactaaacttgaaaaaaactcacattttgatgtggaaccaaattctgatttgagaaccaagttgatttgatggattttgcaggagaattagctc

SEQ ID NO: 1786 - DNA, 736 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacactgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacattttttttgtcattatcttagttaaccg

SEQ ID NO: 1787 - DNA, 793 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtggggtggtggccatcgccagcaatattggtggaactgaaaatggagtgcacatcacaaagattgaatcctcctcaattcttgtgccataccatggatggttagttcatcccggcttttttgtttgtcattggaagttcttttattgattcaatttttatagcgtgttcggaaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgatttgatggattttgcaggagaattagccacagaactcaccatcaaaatcatggacacattgagaaggatgaatcctgggttccagtatgtgattaactacttcctctatagttatttttgattcaattaaatttatttatttataagttcaagaaaaaggaatctttatacttcagataaagctgttcttgaacattttttttgtcattattctagtttaaccga

SEQ ID NO: 1788 - DNA, 586 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacatttttgatgtggaaccaaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaaacggaatctttatacttcagataaagctgttcttgaacattttttttagtcattatcttagttaaccgag

SEQ ID NO: 1789 - DNA, 828 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcccccggagcaggtggtggccatcgccagccacgatggcggcaagcaggcgctggagacggtccagcggctgttgccggtgctgtgccaggcccacggcttgcattcctcaattcttgtgccataccatggatggttagttcatcccggctttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaatcacatttttgatgtggaaccaaatctgatttgagaaccaagttgattttgatggattttgcaggagaattagcccacagaactcaccatcaaaatcatggacacattgagaagggatgaatcctgggttccagtatgtgattactacttcctctatagttattttttggattcaattaattttattttatttaataagttcaagaaaaacggaatctttatacttcagataaagctgttcttgaaacatttttttcgtcattatcttagttaaccg

SEQ ID NO: 1790 - DNA, 708 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaacacatcttgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttattttatttaataagttcaagaaaaaaggaatctttatacttcagataaagctgttcttgaacatttttttt

SEQ ID NO: 1791 - DNA, 638 bp, Artificial
  Glycine max FAD3A mutation created with TALEN pair GmFAD3_T02.1
cactgctttgttatgcctacctcatttcatttggctttagacaacttaaatttgagatctttattatgtttttgcttatatggtaaagtgattcattcttcacattgaattgaacagtggccatggaagcttttcagacagcccttttctaaatagcctggtgggacattcctcaattcttgtgccataccatggatggttagttcatcccggcttttttgttttgtcattggaagttctttttattgattcaatttttatagcgtgttcggaaacgcgtttcagaaaataatgaaaatacatctttgaatctgaaagttataacttttagcttcattgtcattgaaagttcttttattaattatatttttattgcgtgtttggaatcccatttgagaaataagaaatcacgtttaaaatgtgaaagttataactattacttttgactaaacttgaaaaaactcacattttgatgtggaaccaaatctgatttgagaaccaagtttgattttgatggattttgcaggagaattagccacagaactcaccatcaaaagtcatggacacattgagaaggatgaatcctgggttccagtatgtgattaacctacttcctctatagttatttttcgattcaa

SEQ ID NO: 1792 - DNA, 471 bp, Artificial
  Glycine max FAD3A mutation created with TALEN pair GmFAD3_T02.1
cactgctttgttatgcctacctcatttcatttggctttatgacaacttaaatttgagatctttattatgtttttgcttatatggtaaagtagattcattcttcacattgaattgaacagtggccatggaagcttttcagacagcccttttctaaatagcctggtgggactgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcaca

SEQ ID NO: 1793 - DNA, 733 bp, Artificial
  Glycine max FAD3A mutation created with TALEN pair GmFAD3_T02.1
cactgctttgttacctacctcatttcatttggctttagacaacttaaatttgagatctttattatgttttttgcttatatggtaaagtgattcattcttcacattgaattgaacagtggccatggaagcttttcagacagcccttttctaaatagcctggtgggattgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaaggaatctttatacttcagataaagctgttcttgaacattttttttgtcattatcttagttaaccg

SEQ ID NO: 1794 - DNA, 691 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacattgccggtgctgtgccaggcccacggcttgacccccacgacaggtggtggcattcctcaattcttgtgccataccatggatggttagttcatcccggcttttttgtttgtcattggaagttcttttattgattcaatttttatagcgtgttcggaaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaagtcacattttgatgtggaaccaaatctgatttgagaaccaagttgatttgatggattttgcaggagaattagccacagaactcaccatcaaatcatggacacattgagaaggatgaatcctgggttccagtatgtgattaactacttcctctatagttatttttgattcaattaaa

SEQ ID NO: 1795 - DNA, 738 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttcgtcattatctagttaaccg

SEQ ID NO: 1796 - DNA, 798 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggggtcaagccgtgggcctggcacagcaccggcaacagccgctggaccgtctccagcgcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagtttgattttgatggattttgcaggagaattagccacagaactcaccatcaaatcatggacacattgagaaggatgaatcctgggttccagtatgtgattaactacttcctctatagttatttttgattcaattgaaatttatttatttaataagttcaagaaaaacggaatctttcatacttcagataaaggctgtttcttgaacatttttttcgtcattatcttagtaaccgagaag

SEQ ID NO: 1797 - DNA, 704 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggactcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaataagaaatcacgtttaaaatgtgaaagttataactattaacttttgactaaacttgaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaagggaatcttatacttcagataaagctgttcttgaacattttttt

SEQ ID NO: 1798 - DNA, 740 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacagcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactaacttcctctatagtatttttgattcaattaaatttaattttattttaattaagttcaagaaaaataggaaatctttatacttcagataaagctgttcttgaacatttttttgtcattatctagttaaccg

SEQ ID NO: 1799 - DNA, 710 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggttcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaatgtgaaagttataactattaacttttgactaaacttgaaaaaattcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaagggaatctttatacttcagataaagctgttcttgaacattttttt

SEQ ID NO: 1800 - DNA, 637 bp, Artificial
  Glycine max FAD3A mutation created with TALEN pair GmFAD3_T02.1
cactgctttgttatgcctacctcatttcatttggctttagacaacttaaatttgagatctctttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaaacttgaaaaaatcacatttttgatgtggaaccaaatctgatttgagaaccaagttgattttgatggatttttgcaggagaattagccacagaactcaccatcaaaatcatggacacattgagaagggatgaattcctgggttccagtatgtgattaactacttcctctatagttatttttgattcaattaaatttatttatttaataatgttcaagaaaaaaaggaattctttatacttcagataaagctgttcttgaacatttttttgtcattatcttagttaaccgag

SEQ ID NO: 1801 - DNA, 733 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacatattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacattttttttgtcattatcttagttaaccg

SEQ ID NO: 1802 - DNA, 653 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggatttgcaggagaattagccacagaactcaaccatcaaaagtcatggacaacattgagaaggatgaatccatgggttccagtatgtgattaactacttcctctatagttatttttgattcaattaaatttattta

SEQ ID NO: 1803 - DNA, 643 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaattcggcttttttgtttgtcattggaagttcttttattgattcaatttttatagcgtgttcggaaacgcgtttcagaaaataatgaaatacatcttgaatctgaaagttataacttttagcttcattgtcattgaaaagttcttttattaattatatttttattgcgtgtttggaatccatttgagaaataagaaatcacgtttaaaatgtgaaagttataactattaacttttgactaaacttgaaaaaattcacatttttgatgtggaaccaaatctgatttgagaaccaagttgattttgatggattttgcaggagaattagccacagaactcaccatcaaaaatcatggacacattgagaaggatgaatcctgggttccagtatgtgattaactacttcctctatagttatttttgattcaattaaatttatttatttaataagttcaagaaaaaatggaatctttatacttcagataaagctgtt

SEQ ID NO: 1804 - DNA, 725 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacagcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggatttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatactcagataaagctgttcttgaacattttttttgtcattatct

SEQ ID NO: 1805 - DNA, 631 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaataagaaatcacgtttaaaatgtgaaagttataactattaacttttgactaaacttgaaaaaattcacatttttgatgtggaaccaaatctgattgagaaccaagttgattttgatggattttgcaggagaattagccacagaactcaccatcaaaatcatggacacattgagaaggtatgaatcctgggttccagtatgtgattaactacttcctctatagttattttgattcaa

SEQ ID NO: 1806 - DNA, 736 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacagcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttgtcattatctaattaaccg

SEQ ID NO: 1807 - DNA, 591 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagcattcctcaattcttgtgccataccatggatggttagttcatcccggcttttttgtttgtcattggaagttcttttattgattcaatttttatagcgtgttcggaaacgcgtttcagaaataatgaaatacatcttgaatctgaaagttataacttttagcttcattgtcattgaaagttcttttattaattatatttttattgcgtgtttggaatcccatttgagaaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaaatcatggacacattgagaaggatgaatcctgggttccagtatgtgattaactacttcctctatagtta

SEQ ID NO: 1808 - DNA, 586 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacatttttgatgtggaaccaaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaacggaatctttatacttcagataaagctgttcttgaacattttttttagtcattatcttagttaaccgag

SEQ ID NO: 1809 - DNA, 735 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggattgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttgtcattatctagttaaccg

SEQ ID NO: 1810 - DNA, 665 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaatgtgaagttataactattaacttttgactaaacttgaaaaaattcacatttttgatgtggaaccaaatctgatttgagaaccaagttgattttgatggattttgcaggagaatttagccacagaactcaccatcaaaatcatggacacattgagaaggatgaatcctgggttccagtatgtgattaactacttcctctatagttattttgattcaattaaatttatttatttaataagttcaagaaaaaa

SEQ ID NO: 1811 - DNA, 718 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacatttttttttcca

SEQ ID NO: 1812 - DNA, 736 bp, Artificial; identical to SEQ ID NO: 1687
  Glycine max FAD3A mutation created with TALEN pair GmFAD3_T02.1

SEQ ID NO: 1813 - DNA, 622 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtggaattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaactgtgaaagttataactattaacttttgactaaacttgaaaaaattcacatttttgatgtggaaccaaatctgatttgagaacccaagttgattttgatggattttgcaggagaattagccacagaactcaccatcaaaatcatggacacattgagaaggatgaatcctgggttccagtatgtgattaactacttcctctatagtt

SEQ ID NO: 1814 - DNA, 737 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacttgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttcgtcattatctagttaaccg

SEQ ID NO: 1815 - DNA, 728 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacagctgtctccattcattgtgcatcatcacagtggatgtgtgtcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatactcagataaagctgttcttgaacatttttttgtcattatctag

SEQ ID NO: 1816 - DNA, 737 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggactgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttattttaataagtttcaagaaaaaaggaatctttatacttcagataaagctgttcttgaacattttttttgtcattatcttagttaaccg

SEQ ID NO: 1817 - DNA, 736 bp, Artificial; identical to SEQ ID NO: 1430
  Glycine max FAD3A mutation created with TALEN pair GmFAD3_T02.1

SEQ ID NO: 1818 - DNA, 723 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacactattgctggcgatggccaccacctgctccggggtcaagccgtgggcctggcacagcaccggcaacagcgcctggaccgtctccagcgcctgcttgccaccaactcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatattttattgcgtgttggaatcccatttgagaaataagaatcacgtttaaaatgtgaaagttataactattaactttgactaaacttgaaaaaagtcacatttttgatgtggaaccaaatctgatttgagaaccaagttgattttgatggattttgcaggagaattagccacagaactcaccatcaaaatcatggacacattgagaagggatgaatcctgggttccagtatgtgattaactacttcctctatagttattttt

SEQ ID NO: 1819 - DNA, 732 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacacattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggatttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacatttttttgtcattatctagttaacc

SEQ ID NO: 1820 - DNA, 727 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaacacatcttgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaaggaatctttatacttcagataaagctgttcttgaacattttttttgtcattatcttagttaaccg

SEQ ID NO: 1821 - DNA, 700 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggatttgcaggagaattagccacagaactcaccatcaaaatcatggacacattgagaaggatgaatcctgggttccagtatgtgattaactacttcctctatagtatttttgattcaattaatttatttatttataagttcaagaaaaatggaatctttatacttcagataaagctgttctgaa

SEQ ID NO: 1822 - DNA, 548 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttcacattgagatctttattatgttttttgtttgtcattggaagttcttttattgattcaatttttatagcgtgttcggaaacgcgtttcagaaaataatgaaatacatcttgaatctgaaagttataacttttagcttcattgtcattgaaaagttcttttattaattatatttttaattgcgtgtttggaatcccatttgagaaataagaaatcacgtttaaaatgtgaagttataactattaacttttgactaaacttgaaaaaatcacattttgatgtggaaccaaatctgatttgagaaccaagttgattttgatggattttgcaggagaattagccacagaacttccatcaaatcaaatgagcacattgagaaggatgaatcctgggttccagtatg

SEQ ID NO: 1823 - DNA, 732 bp, Artificial; identical to SEQ ID NO: 1644
  Glycine max FAD3A mutation created with TALEN pair GmFAD3_T02.1

SEQ ID NO: 1824 - DNA, 786 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacagtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgcattcctcaattcttgtgccataccatggatggttagttcatcccggcttttttgttgtcattggaagttcttttattgattcaatttttatagcgtgttcggaaacgcgtttcagaaaataatgaaatacatcttgaatctgaaagttataacttttagcttcattgtcattgaaagttcttttattaattatattttattgcgtgtttggaatcccatttgagaataagaaatcacgtttaaaatgtgaaagttataactattaactttgactaaacttgaaaaatcacatttttgatgtggaaccaaatctgatttgagaaccaagttgattttgatggattttgcaggagaattagccacagaactcaccatcaaaatcatggacacattgagaaggatgaattcctgggttccagtatgtgattaagctacttcctctatagttattttttgattcaattaaattt

SEQ ID NO: 1825 - DNA, 732 bp, Artificial
  Glycine max FAD3A mutation created with TALEN pair GmFAD3_T02.1
  misc_feature (266): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacattcctcaattcttgtgccataccatggatggttagttcatcccggcttttttgtttgtcattggaagttctttttattgattcaatttttatagcgngttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacatttttttcgtcattatctagttaaccg

SEQ ID NO: 1826 - DNA, 555 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacttgctggcgatggccaccacctgctggggggtcaagccgtgggcctggcacagcaccggcaacagccgctggaccgtctccagcgcctgcttgccacctgccattgctggcgatggccaccacctgctggggggtcaatgccgtgggcctggcacagcaccggcaacagccgctggaccgtctccatggatggttagttcatcccggctttttgtttgtcattggaagttcttttattgattcaattttatagcgtgttcggaacgcgtttcagaaattaatgaaatacatcttgaatctgaaagttataactttagcattcattgtcattgaaagttcttttattaattatattttcattgctgtgtttggaatcccatttgag

SEQ ID NO: 1827 - DNA, 735 bp, Artificial
  Glycine max FAD3A mutation created with TALEN pair GmFAD3_T02.1
  misc_feature (681): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccattgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttntacttcagataaagctgttcttgaacatttttttcgtcattatctagttaaccg

SEQ ID NO: 1828 - DNA, 711 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaatgtgaaagttataactattaacttttgactaaacttgaaaaaattcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaagggaatctttatacttcagataaagctgttcttgaacattttttt

SEQ ID NO: 1829 - DNA, 617 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcggttttggaatcccatttgagaaataagaaatcacgtttaaaattgtgaaagttataactattaacttttgactaaacttgaaaaaatcacatttttgatgtggaaccaaatctgatttgagaaccaagtttgatttgatggattttgcaggagaattagccacagaactcaccatcaaaatcatggacacattgagaaggatgaatcctgggattccagtatgtgattaactacttcctctatagttatttttgat

SEQ ID NO: 1830 - DNA, 735 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggattgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttataagttcaagaaaaaggaatctttatacttcagataaagctgttcttgaacattttttttcgtcattatcttagttaaccg

SEQ ID NO: 1831 - DNA, 640 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaatt

SEQ ID NO: 1832 - DNA, 715 bp, Artificial
  Glycine max FAD3A mutation created with TALEN pair GmFAD3_T02.1
  misc_feature (681): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacacattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttntacttcagataaagctgttcttgaacattttttt

SEQ ID NO: 1833 - DNA, 641 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacagcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaatt

SEQ ID NO: 1834 - DNA, 621 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaatagaaatcacgtttaaatgtgaagttataactattaacttttgactaaacttgaaaaaatcacatttttgatgttggaaccaaatctgatttgagaaccaagttgatttgatggattttgcaggagaatttagccacagaactcaccatcaaaatcatggacacattgagaaggtatgaatcctgggttccagtatgtgattaactacttcctctatagttatttt

SEQ ID NO: 1835 - DNA, 606 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacactcctcaattcttgtgccataccatggatggttagttcatcccggctttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaa

SEQ ID NO: 1836 - DNA, 656 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaaatcatttatgttttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttattatttaataagttcaagaaaaatggatctttatacttcagataaagctgttcttgaacattttttttgtcattattcttagttaaccgagaatg

SEQ ID NO: 1837 - DNA, 731 bp, Artificial
  Glycine max FAD3A mutation created with TALEN pair GmFAD3_T02.1
  misc_feature (679): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttntacttcagataaagctgttcttgaacattttttttcgtcattatctatgata

SEQ ID NO: 1838 - DNA, 649 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaattttatttta

SEQ ID NO: 1839 - DNA, 733 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacattttttttcgtcattatcttagttaaccg

SEQ ID NO: 1840 - DNA, 560 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggattgcattcctcaattcttgtgccataccatggatggttagttcatcccggctttttgtttgtcattggaagttcttttattgattcaatttttatagcgttgttcggaaacgcgtttcagaaaataatgaaaatacatcttgaatctgaaaagttataacttttagcttcattgtcattgaaagttcttttattaaattatatttttattgcgtgtttggaatcccatttgagaaataagaaaatcacgtttaaaaatgtgaaagttataactattaacttttgactaaaacttgaaaaaaatcacattttgatgtggaaccaaatactgatttgagaaccaagttgattttgatggattttgcaggagaattagccacagaaactcaccatc

SEQ ID NO: 1841 - DNA, 466 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacttcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaaatcacgtttaaaaatgtgaaagttataactattaacttttgacttaaacttgaaaaaat

SEQ ID NO: 1842 - DNA, 737 bp, Artificial; identical to SEQ ID NO: 1675
  Glycine max FAD3A mutation created with TALEN pair GmFAD3_T02.1

SEQ ID NO: 1843 - DNA, 736 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacagcattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagtttcaagaaaaatggaatctttatacttcagataaagctgttcttgaacattttttttcgtcattatcttagttaaccg

SEQ ID NO: 1844 - DNA, 637 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctgatggccctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaatgtgaaagttataactattaactttgactaaacttgaaaaaatcacatttttgatgtggaaccaaatctgatttgagaaccaagttgattttgatggattttgcaggagaatttagccacagaactcaccatcaaaatcatggacacattgagaaggatgaatcctgggttccagtatgtgattaactacttcctctatagttattttgattcaattaaattta

SEQ ID NO: 1845 - DNA, 739 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacaccgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttcgtcattatctagttaaccga

SEQ ID NO: 1846 - DNA, 737 bp, Artificial
  Glycine max FAD3A mutation created with TALEN pair GmFAD3_T02.1
  misc_feature (682): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttntacttcagataaagctgttcttgaacattttttttgtcattatctagttaaccga

SEQ ID NO: 1847 - DNA, 734 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacattttttttgtcattatcttagttaaccg

SEQ ID NO: 1848 - DNA, 736 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtggttgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttattttatttaataagttcaagaaaaatggaatctttatacttcagataaagctgttcttgaacattttttttcgtcattatctaagttaacc

SEQ ID NO: 1849 - DNA, 642 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacttcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatggggggtgattaactacttcctctatagttatttttgattcaatt

SEQ ID NO: 1850 - DNA, 712 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacatttttttt

SEQ ID NO: 1851 - DNA, 736 bp, Artificial; identical to SEQ ID NO: 1652
  Glycine max FAD3A mutation created with TALEN pair GmFAD3_T02.1

SEQ ID NO: 1852 - DNA, 732 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacttgcattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaacgcttcaccatcaaaatcatggacacattgagaaggatgaatcctgggttccagtatgtgattaactacttcctctatagttatttttgattcaattaaatttattttatttaataaagtttcaagaaaaaaggaatctttatacttcagataaagctgttcttgaacattttttttgtcattatctt

SEQ ID NO: 1853 - DNA, 557 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttcacattgagatctttattatgttttttgtttgtcattggaagttcttttattgattcaatttttatagcgtgttcggaaacgcgtttcagaaataatgaaatacatcttgaatctgaaagttataacttttagcttcattgtcattgaaaagttcttttattaattatatttttattgcgtgtttggaatcccatttgagaaataagaaatcacgtttaaaatgtgaagttataactattaacttttgactaaacttgaaaaaatcacatttttgatgtggaaccaaatctgatttgagaaccaagttgattttgatggatttttgcaggagaattagccacagaacttcacaaatcaatgatgcacattgagaaggatgaatcctgggttccagtatgtgattaactac

SEQ ID NO: 1854 - DNA, 720 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttcgtca

SEQ ID NO: 1855 - DNA, 737 bp, Artificial; identical to SEQ ID NO: 1478
  Glycine max FAD3A mutation created with TALEN pair GmFAD3_T02.1

SEQ ID NO: 1856 - DNA, 734 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacgcattcctcaattcttgtgccataccatggatggttagttcatcccggcttttttgtttgtcattggaagttctttttattgattcaatttttatagcgtgttcggaaacgcgtttcaggaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttataagttcaagaaaaatggaatctttatacttcagataaagctgttcttgaacatttttttcgtcattatctagttaaccg

SEQ ID NO: 1857 - DNA, 742 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaattatttatttaataagttcaagaaaaaggaatctttatacttcagataaagctgttcttgaacattttttttgtcattatcttagttaaccg

SEQ ID NO: 1858 - DNA, 670 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacttgcattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggatgaattagccacagaactcaccatcaaaatcatggacacattgagaaggatgaatcctgggttccagtatgtgattaactactcctctatagttatttttgattcaattaaatttatttatttaataagttcaagaaaaat

SEQ ID NO: 1859 - DNA, 734 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggagcattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacattttttttcgtcattatcttagttaaccg

SEQ ID NO: 1860 - DNA, 677 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttcagagggctacatgccctcgccaccagaggactgcatgtcctcaccttcagtagggctacacgccctcgccatcagaggactgcatgtcctcaccttcatagggctacacacctcttgcattcctcaattcttgtgccataccatggatggttagttcatcccggctttttgtttgtcattggaagttcttttattgatcaatttttatagcgtgttcggaaacgcgtttcagaaaataatgaaatacatcttgaatctgaaagttataacttttagcttcattgtcattgaagttcttttattaattatattttattgcgtgtttggaatcccatttgagaaataagaaatcacgtttaaaatgtgaaagttataactattaactttgactaaacttgaaaaaaatcacattttgatgtggaaccaaatctgttgagaaccaagttgaatttgatggattttgcaggaagaatttaagccatcagaactcaccatcaaaat

SEQ ID NO: 1861 - DNA, 736 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacgcattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttctctatagttatttttgattcaattaaatttatttatttaataagttcaagaaaaataggaaatctttataacttcagataaagctgttcttgaacattttttttgtcattatctaagttaaccg

SEQ ID NO: 1862 - DNA, 624 bp, Artificial
  Glycine max FAD3A mutation created with TALEN pair GmFAD3_T02.1
  misc_feature (250): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacattcctcaattcttgtgccataccatggatggttagttcatcccggcttttttgtttgtcattggaagttcttttattgnttcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacatttttgatgtggaaccaaatctgatttgagaaccaagttgattttgatggattttgcaggagaattagccacagaaactcaccatcaaaagtcatggacacattgagaaggatgaatcctgggttccagtatgtgattaacctacttcctctatag

SEQ ID NO: 1863 - DNA, 729 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggttcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaatagaaatcacgtttaaaatgtgaaagttataactattaacttttgactaaactgaaaaaatcacatttttgatgtggaaccaaatctgatttgagaaccaagttgattttgatggattttgcaggagaatttagccacagaactcaccatcaaaatcatggacacattgagaaggatgaatcctgggttccagtatgtgattaactacttcctctatagttattttgattcaattaaatttatttatttaataagttcaagaaaaaaggaatctttatacttcagataaagctgattcttgaacattttttgtcattatcttagttaaccgag

SEQ ID NO: 1864 - DNA, 729 bp, Artificial
  Glycine max FAD3A mutation created with TALEN pair GmFAD3_T02.1
  misc_feature (675): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacactcaattcttgtgccataccatggatggttagttcatcccggcttttttgtttgtcattggaagttctttttattgattcaatttttatagcgtgttcggaaacgcgtttcagaaaataatgaaatacatcttgaatctgaaagttataaacttttagtcttcattgtcattgaaagttacttttattaattatattttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttntacttcagataaagctgttcttgaacattttttttgtcattatctagttaaccg

SEQ ID NO: 1865 - DNA, 746 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatctgttgccggtgctgtgccaggcccacggcttgaccccccagcaggtggtggccatcgccagcaataatggtggcaagcaggcgctggagacggtccagcggcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatattttattgcgtgtttggaatccccatttgagaaataagaaatcacgtttaaaatgtgaaagttataactattaacttttgactaaacttgaaaaaatcacatttttgatgtggaaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaatt

SEQ ID NO: 1866 - DNA, 632 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaattcggcttttttgtttgtcattggaagttcttttattgattcaatttttatagcgtgttcggaaacgcgtttcagaaaataatgaaatacatcttgaatctgaaagttataacttttagcttcattgtcattgaaaagttcttttattaattatatttttattgcgtgtttggaatcccatttgagaaataagaaaatcacgtttaaaatgtgaaagttataactattaactttttgactaaacttgaaaaaatcacattttgatgtggaaaccaaatctgatttgagaaccaagttgattttgatggattttgcaggagaattagccacagaactcaccatcaaaaatcatggacacattgagaaggatgaatcctgggttccagtatgtgattaactacttcctctatagttattttgattcaattaaatttatttatttaataagttcaagaaaaaaggaatctttatacttcag

SEQ ID NO: 1867 - DNA, 740 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacagcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttattttcatttaataagttcaagaaaaatggaatctttatacttcagataaagctgttcttgaacattttttttcgtcattatctagttaaccg

SEQ ID NO: 1868 - DNA, 737 bp, Artificial
  Glycine max FAD3A mutation created with TALEN pair GmFAD3_T02.1
cactgctttattatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacagcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttcgtcattatctagttaaccg

SEQ ID NO: 1869 - DNA, 733 bp, Artificial; identical to SEQ ID NO: 1839
  Glycine max FAD3A mutation created with TALEN pair GmFAD3_T02.1

SEQ ID NO: 1870 - DNA, 737 bp, Artificial; identical to SEQ ID NO: 1432
  Glycine max FAD3A mutation created with TALEN pair GmFAD3_T02.1

SEQ ID NO: 1871 - DNA, 713 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacatcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaatgtgaagttataactattaacttttgactaaacttgaaaaaattcacatttttgatgtggaaccaaatctgatttgagaaccaagttgattttgatggattttgcaggagaatttagccacagaactcaccatcaaaatcatggacacattgagaaggtatgaatcctgggttccagtatgtgattaactacttcctctatagttatttttgattcaattaaatttatttatttaataagttcaagaaaaaaggaatctttatacttcagataaagctgttcttgaacatttttttgtc

SEQ ID NO: 1872 - DNA, 730 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtggtgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacattttttttgtcattatcttagttaacc

SEQ ID NO: 1873 - DNA, 725 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacttcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaaatctttatacttcagataaaagctgttcttgaacattttttttgtcattatct

SEQ ID NO: 1874 - DNA, 731 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggagcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaatttatttattataagttcaagaaaaaggaatctttatacttcagataaagctgttcttgaacattttttttcgtcattatcttagttaaccg

SEQ ID NO: 1875 - DNA, 737 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacatattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaacctacttcctctatagttatttttgattcaattaaatttatttatttaataagttcaagaaaaaaggaatctttatacttcagataaagctgttcttgaacattttttttcgtcattatcttagttaaccg

SEQ ID NO: 1876 - DNA, 713 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcatttgtcattgaaaagttctttttattaattatattttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaaaggaatctttatacttcagataaagctgttcttgaacattttttttgtcattatcttagttaaccgag

SEQ ID NO: 1877 - DNA, 736 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttgtcattatctagttaaccg

SEQ ID NO: 1878 - DNA, 541 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacaatggccaccacctgctggggggtcaagccgtgggcctggcacagcaccggcaacagccgctggaccgtctccagcgcctgcttgccaccgccattgctggcgatggccaccacctgctggggtcaagccgtgggcctggcacagcaccggcaacagccgctggaccgtctccagcgcctgcttgccaccgcattcctcaattcttgtgccataccatggatggttagttcatcccggctttttgtttgtcattggaagttcttttattgattcaatttttatagcgtgttcggaaacgcgttcagaaaataatgaatacatcttgaatctgaaagttataacttttagcttcattgtcattgaaaagttc

SEQ ID NO: 1879 - DNA, 734 bp, Artificial
  Glycine max FAD3A mutation created with TALEN pair GmFAD3_T02.1
cactgctttcttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggatgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaaggaatctttatacttcagataaagctgttcttgaacattttttttgtcattatcttagttaaccg

SEQ ID NO: 1880 - DNA, 733 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggagcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacattttttttcgtcattatcttagttaaccg

SEQ ID NO: 1881 - DNA, 813 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtggtatcagctcactcaaaggcggtaatacggttatccacagaatcaggggataacgcaggaaagaacatgtgagcaaaaggccagcaaaaggccaggaaccgtaaaaaggccgcataccatggatggttagttcatcccggctttttgtttgtcattggaagttcttttattgattcaatttttatagcgtgttcggaaaacgcgtttcagaaaataatgaaatacatcttgaatctgaaagttataacttttagcttcattgtcattgaaagttcttttattaattatattttattgcgtgtttggaatcccatttgagaaataagaaatcacgtttaaaatgtgaaagttataactattaactttgactaaacttgaaaaattcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaacggaatctttatacttcagataaagctgttcttgaacatttttttgtcattatctagttaa

SEQ ID NO: 1882 - DNA, 732 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcgatggccaccacctgctccggggtcaagccgtgggcctggcacagcaccggcaacagccgctggaccgtctccagcgcctgcttgccaccattattgctggcgatggccaccttgcattcctcaattcttgtgccataccatggatggttagttcatcccggctttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaatcacattttgatgtggaaccaaatctgatttgagaaccaagttgattttgatggattttgcaggagaattagccacagaactcaccatcaaaatcatggacacattgagaagggatgaatcctgggttccagtatgtgattaactacttcctctatagttatttttt

SEQ ID NO: 1883 - DNA, 736 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggactgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaacctacttcctctatagttatttttgattcaattaaatttatttatttaataagttcaagaaaaatggaatctttatacttcagataaagctgttctgaacatttttttcgtcattatctagttaaccg

SEQ ID NO: 1884 - DNA, 624 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacatcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatag

SEQ ID NO: 1885 - DNA, 639 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacatcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaatgtgaaagttataactattaacttttgactaaacttgaaaaaatcacatttttgatgttggaaccaaatctgatttgagaaccaagttgatttgaggattttgcaggagaatttagccacagaacttcaccatcaaaatcattggacacattgaagaaggtatgaatcctgggttccaagtatgtgattaactacttcctctatagttattttgattcaattaaa

SEQ ID NO: 1886 - DNA, 700 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagtc

SEQ ID NO: 1887 - DNA, 709 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaatgtgaaagttataactattaacttttgactaaacttgaaaaaattcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaagggaatctttatacttcagataaagctgttcttgaacattttttt

SEQ ID NO: 1888 - DNA, 736 bp, Artificial; identical to SEQ ID NO: 1687
  Glycine max FAD3A mutation created with TALEN pair GmFAD3_T02.1

SEQ ID NO: 1889 - DNA, 737 bp, Artificial; identical to SEQ ID NO: 1432
  Glycine max FAD3A mutation created with TALEN pair GmFAD3_T02.1

SEQ ID NO: 1890 - DNA, 728 bp, Artificial
  Glycine max FAD3A mutation created with TALEN pair GmFAD3_T02.1
cactgctttgttatgcctacctcatttcatttggctttagacaacttaaatttgagatctttattatgtttttgcttatatggtaaagtgattcattcttcacattgaattgaacagtggccatggaagcttttcagacagcccttttctaaatagcctggtgggacacttgcattcctcaaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaagtcatggacacattgagaaggatgaatcctgggttccagtatgtgattaacctacttcctctatagttatttttgattcaattaaattatttatttaataagttcaagaaaaaggaatctttatacttcagataaagctgttcttgaacatttttttcgtcattatc

SEQ ID NO: 1891 - DNA, 737 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatccgggttccagtatgtgattaactacttcctctatagttatttttgatcaattaaattttatttatttaataagttcaagaaaaatggaatctttataactcagataaagctgttcttgaacattttttttcgtcattatctaagttaaccgagaa

SEQ ID NO: 1892 - DNA, 730 bp, Artificial
  Glycine max FAD3A mutation created with TALEN pair GmFAD3_T02.1
  misc_feature (677): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggatgcattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaatttatttatttataagttcaagaaaaatggaatctttntacttcagataaagctgttcttgaacattttttttgtcattatctagttaacc

SEQ ID NO: 1893 - DNA, 739 bp, Artificial
  Glycine max FAD3A mutation created with TALEN pair GmFAD3_T02.1
  misc_feature (252): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacagcattcctcaattcttgtgccataccatggatggttagttcatcccggcttttttgtttgtcattggaagttctttttattgnttcaatttttatagcgtgttcggaaacgcgtttcagaaaattaatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaaacttgaaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaatttattttatttaataagttcaagaaaaatggaatctttatacttcagataaagctgttcttgaacatttttttcgtcattatctagttaaccg

SEQ ID NO: 1894 - DNA, 728 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataaagtttcaagaaaaatggaatctttatacttcagataaagctgttcttgaacattttttttgtcattatct

SEQ ID NO: 1895 - DNA, 733 bp, Artificial
  Glycine max FAD3A mutation created with TALEN pair GmFAD3_T02.1
  misc_feature (653); (682): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacatgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaaacttgaaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagtatttttgattcaattaatttatttntttataagttcaagaaaatggaatctttntacttcagataaagctgttctgaacattttttttcgtcattatctagttaa

SEQ ID NO: 1896 - DNA, 683 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataaacttttagcttcattgtcattgaaaagttctttttattaattatattttattgcgtgtttggaatcccatttgagaaataagaaatcacgtttaaaaatgtgaaagttataactattaacttttgactaaaacttgaaaaaatcacatttttgatgtggaaccaaatctgattttgagaaccaagttgatttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaaaggaatctttatacttcagataaagctg

SEQ ID NO: 1897 - DNA, 737 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggattgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataaagtttcaagaaaaaaggaatctttatacttcagataaagctgttcttgaacattttttttgtcattatcttagttaaccg

SEQ ID NO: 1898 - DNA, 737 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacatattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttcgtcattatctaagttaaccga

SEQ ID NO: 1899 - DNA, 628 bp, Artificial
  Glycine max FAD3A mutation created with TALEN pair GmFAD3_T02.1
  misc_feature (392): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaaagttataactattaacttttgactaaaacttgaaaaaagtcacatttttgatgnggaaccaaatctgatttgagaaccaagttgattttgatggattttgcaggagaattagccacagaactcaccatcaaaatcatggacacattgagaaggatgaatcctggttccagtatgtgattaactacttcctctatagttatttttgattcaattaaatttatttatttaataagttcaagaaaaaaggaatctttatacttcagataaagctgttcttgaacatttttttt

SEQ ID NO: 1900 - DNA, 734 bp, Artificial
  Glycine max FAD3A mutation created with TALEN pair GmFAD3_T02.1
  misc_feature (680): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacaagcattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttntacttcagataaagctgttcttgaacattttttttcgtcattatctagttaacc

SEQ ID NO: 1901 - DNA, 663 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtggtcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaa

SEQ ID NO: 1902 - DNA, 747 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacatacaatctgctctgatgccgcatagttaagccagccccgacacccgccatgcattcctcaattcttgtgccataccatggatggttagttcatcccggcttttttgttgtcattggaagttcttttattgattcaatttttaagcgtgttcggaaacgcgtttcagaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaaattaaatttatttatttaataagttcaagaaaaaggaatctttatacttcagataaagctgttcttgaacattttttttgtcattatcttag

SEQ ID NO: 1903 - DNA, 740 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacttgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttattttatttaataagttcaagaaaaatggaatctttatacttcagataaagctgttcttgaacattttttttcgtcattatcttagttaaccg

SEQ ID NO: 1904 - DNA, 733 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttcgtcattatcttagttaacc

SEQ ID NO: 1905 - DNA, 732 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtggtggccatcgccagcaatggcggtggcaagcaggcgctggagacggtccagcggctgttgccggtgctggcgatggccaccacctgctccggggtcaagccgtgggccatcattcctcaattcttgtgccataccatggatggttagttcatcccggctttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaaattagccacagaactcaccatcaaaatcatggacacattgagaaggatgaatcctgggttccagtatgtgattaactacttcctctatagttattttt

SEQ ID NO: 1906 - DNA, 719 bp, Artificial
  Glycine max FAD3A mutation created with TALEN pair GmFAD3_T02.1
cactgctttgttatgcctacctcatttcatttggctttagacaacttaattgtgactttattatgttttttgcttatatggtaaagtgattcattcttcacattgaattgaacagtggccatggaagcttttcagacagcccttttctaaacatcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaattgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttattaataagttcaagaaaaaggaatctttatacttcagataaagctgattcttgaacatttttttagtcattatcttagttaaccgag

SEQ ID NO: 1907 - DNA, 739 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttattttatttaataagttcaagaaaaatggaatctttatacttcagataaagctgttcttgaacattttttttcgtcattatctagttaaccg

SEQ ID NO: 1908 - DNA, 734 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggagcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttattttatttaataagttcaagaaaaatggaatctttatacttcagataaagctgttcttgaacattttttttgtcattatctagttaaccg

SEQ ID NO: 1909 - DNA, 600 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttcttttattaattatattttattgcgtgtttggaatcccatttgagaaataagaaatcacgtttaaaattgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagtta

SEQ ID NO: 1910 - DNA, 732 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacttcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacattttttttgtcattatcttagttaaccg

SEQ ID NO: 1911 - DNA, 627 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggttcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaataagaatcacgtttaaaatgtgaagttataactattaactttgactaaacttgaaaaaatcacatttttgatgttggaaccaaatctgaatttgagaaccaatgttgattttgatggattttgcaggagaatttagccacagaacttcatccatcaaaatcattggacacattgagaaggatgaatcctgggttccaagtatgtgattaactacttcctctatagttatttt

SEQ ID NO: 1912 - DNA, 734 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacaacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacatttttttcgtcattatcttagttaaccg

SEQ ID NO: 1913 - DNA, 729 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcctttagacaagctgtgaccgtgtccgggagcttgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaatttatttatttataagttcaagaaaaaggaatctttatacttcagataaagctgttcttgaacattttttttcgtcattatcttagttaacc

SEQ ID NO: 1914 - DNA, 733 bp, Artificial
  Glycine max FAD3A mutation created with TALEN pair GmFAD3_T02.1
  misc_feature (250); (678): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggaccattcctcaattcttgtgccataccatggatggttagttcatcccggcttttttgtttgtcattggaagttctttttattgnttcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacatttttgatgtggaaccaaatctgatttgagaaccaagttgattttgatggattttgcaggagaattagccacagaactcaccatcaaaagtcatggacacattgagaaggatgaatcctgggttccagtatgtgattaacctacttcctctatagttatttttgattcaattaatttatttattataagttcaagaaaatggaatctttntacttcagataaagctgttcttgaacattttttttcgtcattatctagttaaccg

SEQ ID NO: 1915 - DNA, 691 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggactcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaataagaaatcacgtttaaaatgtgaagttataactattaacttttgactaaacttgaaaaaattcacatttttgatgtggaaccaaatctgatttgagaaccaagttgatttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaagggaatctttatacttcagataaagctg

SEQ ID NO: 1916 - DNA, 732 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaatggaatctttatacttcagataaagctgttcttgaacatttttttgtcattatctagttaaccg

SEQ ID NO: 1917 - DNA, 737 bp, Artificial; identical to SEQ ID NO: 1679
  Glycine max FAD3A mutation created with TALEN pair GmFAD3_T02.1
  misc_feature (683): n is a or c or t or g

SEQ ID NO: 1918 - DNA, 734 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacaattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacattttttttgtcattatcttagttaaccg

SEQ ID NO: 1919 - DNA, 734 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggttgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacattttttttcgtcattatcttagttaacc

SEQ ID NO: 1920 - DNA, 739 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaacctacttcctctatagttatttttgattcaattaaatttatttatttaataagttcaagaaaaatggaatctttatacttcagataaagctgttcttgaacattttttttcgtcattatctagttaaccga

SEQ ID NO: 1921 - DNA, 736 bp, Artificial; identical to SEQ ID NO: 1430
  Glycine max FAD3A mutation created with TALEN pair GmFAD3_T02.1

SEQ ID NO: 1922 - DNA, 741 bp, Artificial
  Glycine max FAD3A mutation created with TALEN pair GmFAD3_T02.1
  misc_feature (251): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacgcattcctcaattcttgtgccataccatggatggttagttcatcccggcttttttgtttgtcattggaagttctttttattgnttcaatttttatagcgtgttcggaaacgcgtttcagaaaattaatgaaaatacatcttgaatctgaaaagttataacttttagcttcattgtcattgaaagttcttttattaattatatttttattgcgtgtttggaatcccatttgagaaataagaaatcacgtttaaaaatgtgaaagttataactattaacttttgactaaacttgaaaaaaactcacatttttgatgtggaaccaaatctgatttgagaaccaagttgattttgatggattttgcaggagaattagccacagaactcaccatcaaaagtcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttcgtcattatctagttaaccg

SEQ ID NO: 1923 - DNA, 726 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacagcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggatttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttgtcattatct

SEQ ID NO: 1924 - DNA, 685 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcaattcttgtgccataccatggatggttagttcatcccggcttttttgtttgtcattggaagttctttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttataagttcaagaaaaaggaatctttatacttcagat

SEQ ID NO: 1925 - DNA, 699 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcatcttctcatgaattgaatacagtggccatggaagcttttcagacagcccttttctaaatagcctggtgggacacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaatttatttatttataagttcaagaaaaaggaatctttatacttcagataaagctgttc

SEQ ID NO: 1926 - DNA, 705 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggatcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaataagaaatcacgtttaaaatgtgaaagttataactattaacttttgactaaacttgaaaaaatcacatttttgatgtggaaccaaatctgatttgagaaccaagttgattttgatggattttgcaggagaatttagccacagaactcaccatcaaaatcatggacacattgagaaggatgaatcctgggttccagtatgtgattaactacttcctctatagttatttttgattcaattaaatttatttatttaataagttcaagaaaaagggaatcttatacttcagataaagctgttcttgaacattttttt

SEQ ID NO: 1927 - DNA, 644 bp, Artificial
  Glycine max FAD3A mutation created with TALEN pair GmFAD3_T02.1
  misc_feature (469): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctgggcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaatgtgaagttataactattaacttttgactaaacttgaaaaaattcacatttttgntgtggaaccaaatctgatttgagaacccaatgttgattttgatggattttgcaggagaatttagcccacagaactcaccatcaaaattcatggacacattgagaaggatgaatcctgggttccagtatgtgattaactacttcctctatagttatttttgattcaattaaattta

SEQ ID NO: 1928 - DNA, 732 bp, Artificial
  Glycine max FAD3A mutation created with TALEN pair GmFAD3_T02.1
  misc_feature (678): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtggttgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttntacttcagataaagctgttcttgaacattttttttgtcattatctagttaaccg

SEQ ID NO: 1929 - DNA, 701 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttcttttattaattatatttttattgcgtgtttggaatcccatttgagaaataagaaatcacgtttaaaatgtgaagttataactattaacttttgactaaacttgaaaaaatcacattttgatgtggaaccaaatctgatttgagaaccaagttgatttttgatggattttgcaggagaattagccacagaactcaccattcaaaaatcatggacacattgagaaggatgaatcctgggttccagtatgtgattaactacttcctctatagttattttgatcaattaaatttatttatttaataagttcaagaaaaaggaatctttatacttcagataaagctgttcttgaacattttttttgtcattatcttagttaaccgagaa

SEQ ID NO: 1930 - DNA, 604 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaaagttataactattaacttttgactaaacttgaaaaaatcacatttttgatgtggaaccaaatctgattgagaaccaagttgattttgatggattttgcaggagaatttagccacatgaactcaccatcaaaatcatggacacattgagaaggatgaatcctgggttccagtatgtgattaactacttcctctatagttatttttgattcaattaatttatttatttaataagttcaagaaaaaatggaatctttat

SEQ ID NO: 1931 - DNA, 721 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacatttttttgtca

SEQ ID NO: 1932 - DNA, 670 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggggggtcaagccgtgggcctggcacagcaccggcaacagccgctggaccgtctccagcgccttgcattcctcaattcttgtgccataccatggatggttagttcatcccggcttttttgtttgtcattggaagttcttttattgattcaatttttatagcgtgttcggaaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaatcatggacacattgagaaggatgaatcctgggttccagtatgtgattaactacttcctc

SEQ ID NO: 1933 - DNA, 739 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggattgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaactcacatttttgatgtggaaccaaatctgatttgagaaccaagtttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacattttttttcgtcattatcttagttaacc

SEQ ID NO: 1934 - DNA, 726 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaaatctttatacttcagataaagctgttcttgaacatttttttgtcattatct

SEQ ID NO: 1935 - DNA, 620 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggttcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaatgtgaaagttataactattaacttttgactaaacttgaaaaaattcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagtta

SEQ ID NO: 1936 - DNA, 734 bp, Artificial
  Glycine max FAD3A mutation created with TALEN pair GmFAD3_T02.1
  misc_feature (679); (689): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacagcattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaatttatttatttataagttcaagaaaaatggaatctttntacttcaganaaagctgttcttgaacattttttttcgtcattatctagttaaccg

SEQ ID NO: 1937 - DNA, 727 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacatcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttattttatttaataagttcaagaaaaatggaatctttatacttcagataaagctgttcttgaacattttttttcgtcattatct

SEQ ID NO: 1938 - DNA, 738 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttattttatttaataagtttcaagaaaaaaggaatctttatacttcagataaagctgttcttgaacattttttttcgtcattatcttagttaacc

SEQ ID NO: 1939 - DNA, 713 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaattcttaatacttcagataaagctgttcttgaacattttttt

SEQ ID NO: 1940 - DNA, 715 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggatgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaagtctttatacttcagataaagctgttcttgaacatttttttt

SEQ ID NO: 1941 - DNA, 680 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaattcggcttttttgtttgtcattggaagttcttttattgattcaatttttatagcgtgttcggaaacgcgtttcagaaaataatgaaatacatcttgaatctgaaagttataacttttagcttcattgtcattgaaaagttcttttattaattatatttttattgcgtgttttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttacttgaacattttttttgtcattatcttagttaaccgag

SEQ ID NO: 1942 - DNA, 630 bp, Artificial
  Glycine max FAD3A mutation created with TALEN pair GmFAD3_T02.1
cactgctttgttatgcctacctcatttcatttggctttagacaacttaaatttgagatctttattattcctcaattcttgtgccataccatggatggttagttcatcccggcttttttgtttgtcattggaagttcttttattgattcaatttttatagcgtgttcggaaacgcgtttcagaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggatttttgcaggagaattagccacagaactcaccatcaaaatcatggacacattgagaaggatgaatcctgggttccagtatgtgattaactacttcctctatagttatttttgattcaattaaatttatttatttaataagttcaagaaaaaaggaatctttatacttcagataaagctgttcttgaacattttttttgtcattatcttagttaaccgag

SEQ ID NO: 1943 - DNA, 712 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacatttttttt

SEQ ID NO: 1944 - DNA, 734 bp, Artificial
  Glycine max FAD3A mutation created with TALEN pair GmFAD3_T02.1
  misc_feature (680): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacattcctcaattcttgtgtcataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttntacttcagataaagctgttcttgaacattttttttgtcattatctagttaaccg

SEQ ID NO: 1945 - DNA, 718 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacagcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttattttatttaataagttcaagaaaaatggaatctttatacttcagataaagctgttcttgaacatttttttt

SEQ ID NO: 1946 - DNA, 727 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggatcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaatttagccacagaactcaccatcaaaatcatggacacattgagaaggatgaatcctgggttccagtatgtgattaactacttcctctatagttattttgattcaattaaatttatttatttaataagttcaagaaaaaaggaatctttatacttcagataaagctgttcttgaacatttttttgtcattatcttagttaaccga

SEQ ID NO: 1947 - DNA, 717 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggactgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttattttatttaataaagttcaagaaaaatggaatctttatacttcagataaagctgttcttgaacatttttttt

SEQ ID NO: 1948 - DNA, 732 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggagcattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacattttttttcgtcattatcttagttaaccg

SEQ ID NO: 1949 - DNA, 736 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggagattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttattttatttaataagttcaagaaaaaggaatctttatacttcagataaagctgttcttgaacattttttttcgtcattatcttagttaaccg

SEQ ID NO: 1950 - DNA, 735 bp, Artificial
  Glycine max FAD3A mutation created with TALEN pair GmFAD3_T02.1
  misc_feature (679): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacagcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggatttgcaggagaattagccacagaactcaccatcaaaatcatggacacattgagaaggatgaatcctgggttccagtatgtgattaactacttcctctatagttatttttgattcaattaattatttatttaataagttcaagaaaaaggaatctttntacttcagataaagctgttcttgaacattttttttcgtcattatcttagttaaccg

SEQ ID NO: 1951 - DNA, 718 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggagcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaaggaatctttatacttcagataaagctgttcttgaacattttttttgtca

SEQ ID NO: 1952 - DNA, 735 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggattgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttattttatttaataagttcaagaaaaatggaatctttatacttcagataaagctgttcttgaacattttttttgtcattatctagttaaccg

SEQ ID NO: 1953 - DNA, 736 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacatattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttcgtcattatcttagttaaccg

SEQ ID NO: 1954 - DNA, 687 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctttcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgattttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttattaataagttcaagaaaaaagggaatctttatacttcagataaagctg

SEQ ID NO: 1955 - DNA, 737 bp, Artificial; identical to SEQ ID NO: 1675
  Glycine max FAD3A mutation created with TALEN pair GmFAD3_T02.1

SEQ ID NO: 1956 - DNA, 740 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacttgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacatttttgatgtggaaccaaatctgatttgagaaccaagttgattttgatggattttgcaggagaattagccacagaacgtcaccatcaaaatcatggacacattgagaaggatgaatcctgggttccagtatgtgattaactacttcctctatagttatttttgattcaattaaatttattttatttataagttcaagaaaaatggaatctttatacttcagataaagctgttcttgaacattttttttcgtcattatctagttaaccg

SEQ ID NO: 1957 - DNA, 730 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcatctctcatgattgaatacagtggccatggaagcttttcagacagcccttttctaaatagcctggtgggacacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttgtcattatctagttaacc

SEQ ID NO: 1958 - DNA, 724 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacatttttttgtcattatctag

SEQ ID NO: 1959 - DNA, 736 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatatgttatttttgattcaattaaatttatttatttaataagttcaagaaaaatggaatctttatacttcagataaagctgttcttgaacattttttttcgtcattatctagttaacc

SEQ ID NO: 1960 - DNA, 726 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacatgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacattttttttgtcattatctt

SEQ ID NO: 1961 - DNA, 594 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaaagcttttcagacagcccttttctaaatagcctggtgggacacttgcattcctcaattcttgtgccataccatggatggttagttcatcccggcttttttgtttgtcattggaagttcttttattgattcaatttttatagcgtgttcggaaacgcgtttcagaaaaataatgaaaatacatcttgaatctgaaaagttataaacttttagcttcattgtcattgaaagttcttttattaattatatttttattgcgtgtttggaatcccatttgagaaataagaaaatcacgtttaaaaatgtgaaagttataactattaacttttgactaaaacttgaaaaaaactcacattttgatgtggaaccaaaatctgatttgagaaccaaagttgattttgatggattttgcaggagaattagccacagaaactcaccatcaaaatcatggacacattgagaaggatg

SEQ ID NO: 1962 - DNA, 736 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacactgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacatttttttgtcattatcttagttaaccg

SEQ ID NO: 1963 - DNA, 686 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggatgcattcctcaattcttgtgccataccatggatggttagttcatcccggcttttttgtttgtcattggaagttctttttattgatcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaactcacatttttgatgtggaaccaaatctgatttgagaaccaagttgattttgatggattttgcaggagaattgatgccacagaactcaccatcaaaatcatggacacattgagaaggatgaatcctgggttccagtatgtgattaactacttcctctatagttatttttgattcaattaaatttattttatttaataagttcaagaaaaatggaagatcttta

SEQ ID NO: 1964 - DNA, 505 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgcattcctcaattcttgtgccataccatggatggttagttcatcccggcttttttgtttgtcattggaagttctttattgattcaatttttatagcgtgttcggaaacgcgtttcagaaaataatgaaatacatcttgaatctgaaaagttataacttttagcttcattgtcattgaaaagttcttttattaattatatttttgattgcgtgtttggaatcccatttgagaaataagaaatcacgtttaaaatgtgaaagttataactattaacttttgactaaacttgaaaaaattcacatttttgatgtggaaccaaatctgatttgagaaccaagttga

SEQ ID NO: 1965 - DNA, 709 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaatgtgaaagttataactattaacttttgactaaacttgaaaaaattcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaaggaatctttatacttcagataaagctgttcttgaacattttttt

SEQ ID NO: 1966 - DNA, 734 bp, Artificial
  Glycine max FAD3A mutation created with TALEN pair GmFAD3_T02.1
  misc_feature (680): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacagcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttntacttcagataaagctgttcttgaacattttttttcgtcattatctagttaacc

SEQ ID NO: 1967 - DNA, 704 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttcacaagctttccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaaggaatctttatacttcagataaagctgttcttgaacatttttttgtcattatcttagttaaccgagaag

SEQ ID NO: 1968 - DNA, 675 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggatggttagttcatcccggcttttttgtttgtcattggaagttcttttattgattcaatttttatagcgtgttcggaaacgcgttttcagaaaataatgaaatacatcttgaatctgaaagttataactttttagcttcattgtcattgaaagttcttttattaattatatttttattgcgtgtttggaatcccattttgagaaataagaaatcacgtttaaaatgtgaaaagttataactattaacttttgactaaacttgaaaaaatcacatttttgatgtggaaccaaatctgattgagaaccaagttgattttgatggattttgcaggagaatttagccacatgaactcaccatcaaaatcatggacacattgagaaggatgaatcctgggttccagtatgtgattaactacttcctctatagttatttttgattcaattaaatttatttatttaataagttcaagaaaaaaaggaatctttatacttcagaataaagctgttcttgaacattttttttgtcattatcttagtttaaccgagaag

SEQ ID NO: 1969 - DNA, 738 bp, Artificial; identical to SEQ ID NO: 1795
  Glycine max FAD3A mutation created with TALEN pair GmFAD3_T02.1

SEQ ID NO: 1970 - DNA, 808 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacccgccatcgtggctggcgatggccaccacctgctgaggggtcaagttgagcggggcacccgtcagtggcattcctcaattcttgtgccataccatggatggttagttcatcccggcttttttgtttgtcattggaagttcttttattgattcaatttttatagcgtgttcggaaaacgcgtttcagaaaataatgaaatacatcttgaatctgaaagttataacttttagcttcattgtcattgaaagttcttttattaattatattttattgcgtgtttggaatcccatttgagaaataagaaatcacgtttaaaatgtgaaagttataactattaacttttgactaaacttgaaaaaattcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaacggaatctttatacttcagataaaggctgttcttgaacatttttttcgtcattatcttagtaaccgagaag

SEQ ID NO: 1971 - DNA, 732 bp, Artificial
  Glycine max FAD3A mutation created with TALEN pair GmFAD3_T02.1
  misc_feature (657): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcgccagcaatggcggtggcaagcaggcgctggagacggtccagcggctgttgccggtgccataccatggatggttagttcatcccggctttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaagtcacattttgatgtggaaccaaatctgatttgagaaccaagttgatttgatggattttgcaggagaattagccacagaactcaccatcaaaatcatggacacaattgagaaggatgaatcctgggtttccagtatgtgattaactacttccnctatagtttatttttgattcaattaaatttatttatttataagttcaagaaaaaagggaatctttatacttcaga

SEQ ID NO: 1972 - DNA, 735 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagtttcaagaaaaatggaatctttatacttcagataaagctgttcttgaacattttttttgtcattatctagttaacc

SEQ ID NO: 1973 - DNA, 736 bp, Artificial
  Glycine max FAD3A mutation created with TALEN pair GmFAD3_T02.1
  misc_feature (681); (691): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacagcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttntacttcaganaaagctgttcttgaacattttttttcgtcattatctagttaaccg

SEQ ID NO: 1974 - DNA, 609 bp, Artificial
  Glycine max FAD3A mutation created with TALEN pair GmFAD3_T02.1
  misc_feature (472): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggtcctcaattcttgtgccataccatggatggttagttcatcccggcttttttgtttgtcattggaagttcttttattgattcaatttttatagcgtgttcggaaacgcgtttcagaaaataatgaaatacatcttgaatcttgaaaagttataacttttagcttcattgtcattgaaaagttcttttattaattatatttttattgcgtgttttggaatcccatttgagaaataagaaatcacgtttaaaatgtgaaagttataactattaacttttgactaaacttgaaaaaattcacatttttgntgtggaaccaaatctgatttgagaacccaagttgatttttgatggattttgcaggagaattagccacagaactcaccatcaaaatcatggacacattgagaaggatgaatcctgggttccagtatgtgattaactac

SEQ ID NO: 1975 - DNA, 593 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacaatcgccaccaatattggtggcaagcaggcgatggccaccacctgctggggggtcaagccgtgggcctggcacagcaccggcaacagccgctggaccgtctccagcgcctgcttgccaccgccattgcattcctcaattcttgtgccataccatggatggttagttcatcccggctttttgtttgtcattggaagttcttttattgattcaatttttatagcgtgttcggaaacgcgtttcagaaataatgaaatacatcttgaatctgaaagttataacttttagcttcattgtcattgaaagttcttttattaattatatttttattgcgtgtttggaatcccatttgagaaataagaatcacgtttaaatgtgaaagttatactattaactttgactaaacttgaaaaaagtcacatttttg

SEQ ID NO: 1976 - DNA, 742 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacttgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaactcacatttttgatgtggaaccaaatctgatttgagaaccaagttgattttgatggattttgcaggagaattagccacagaacgctcaccatcaaaagtcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttcgtcattatctagttaaccg

SEQ ID NO: 1977 - DNA, 731 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataaagtttcaagaaaaaatggaatctttatacttcagataaagctgttcttgaacattttttttcgtcattatctt

SEQ ID NO: 1978 - DNA, 736 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttcgtcattatcttagttaaccg

SEQ ID NO: 1979 - DNA, 738 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatatgattaactacttcctctatagttatttttgattcaattaaatttattttatttaataagttcaagaaaaatggaatctttatacttcagataaagctgttcttgaacattttttttcgtcattatctaattaaccg

SEQ ID NO: 1980 - DNA, 739 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaagtagtattcattcttcacattgaattgaacagtggccatggaagcttttcagacagcccttttctaaatagcctggtgggacttgttcctcaattcttgtgccataccatggatggttagttcatcccggcttttttgtttgtcattggaagttcttttattgattcaatttttatagcgtgttcggaaacgcgtttcagaaaattaatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttcgtcattatctagttaaccga

SEQ ID NO: 1981 - DNA, 706 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacaacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaac

SEQ ID NO: 1982 - DNA, 535 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggatggttagttcatcccggcttttttgtttgtcattggaagttcttttattgattcaatttttatagcgtgttcggaaacgcgtttcagaaataatgaaatacatcttgaatctgaaagttataacttttagcttcattgtcattgaaagttctttttattaattatatttttattgcgtgtttggaatcccatttgagaaataagaaatcacgtttaaaaatgtgaaagttataactattaacttttgactaaacttgaaaaaatcacatttttgatgtggaaccaaatctgatttgagaaccaagttgattttgatggattttgcaggagaattagccacagaactcaccatcaaaaatcatggacacattgagaaggatgaatcctgggttccagtatgtgattaa

SEQ ID NO: 1983 - DNA, 639 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagcattcctcaattcttgtgccatatcatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaatgtgaaagttataactattaacttttgactaaacttgaaaaaactcacatttttgatgtggaaccaaatctgattttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaa

SEQ ID NO: 1984 - DNA, 737 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacaccgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttcgtcattatctagttaaccg

SEQ ID NO: 1985 - DNA, 728 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaaggaatctttatacttcagataaagctgattcttgaacatttttttgtcattatcttagttaaccgag

SEQ ID NO: 1986 - DNA, 731 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaaatttatttatttaataagttcaagaaaaaaaggaatctttatacttcagataaagctgttcttgaacattttttttgtcattatcttagtttaaccgag

SEQ ID NO: 1987 - DNA, 734 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtggttgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacattttttttcgtcattatcttagttaacc

SEQ ID NO: 1988 - DNA, 739 bp, Artificial
  Glycine max FAD3A mutation created with TALEN pair GmFAD3_T02.1
  misc_feature (683): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttntacttcagataaagctgttcttgaacattttttttcgtcattatctagttaaccga

SEQ ID NO: 1989 - DNA, 798 bp, Artificial
  Glycine max FAD3A mutation created with TALEN pair GmFAD3_T02.1
cactgctttgtatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacacgggcccgtcgactgcagaggcctgcatgcaagcttggcgtaatcatggtcatagctgtttcctgtgtgaaattgttatcctgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatattttattgcgtgttggaatcccatttgagaataagaatcacgtttaaaatgtgaaagttataactattaactttgactaaacttgaaaaagtcacattttgatgtggaaaccaaatctgatttgagaaccaagttgattttgatggattttgcaggagaattagccacagaactcaccatcaaaatcatggacacattgagaagggatgaatcctgggttccagtatgtgattaactacttcctctatagttatttttggattcaattaattttatttatttaataagttcaagaaaaacggaatctttatacttcagataaagctgttcttgaaacaatttttttcgt

SEQ ID NO: 1990 - DNA, 719 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacaagcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacatttttttt

SEQ ID NO: 1991 - DNA, 714 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggagcattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacatttttttgtca

SEQ ID NO: 1992 - DNA, 620 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtggcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaataagaaatcacgtttaaaatgtgaaagttataactattaacttttgactaaacttgaaaaaattcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagtta

SEQ ID NO: 1993 - DNA, 724 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaatggaatctttatacttcagataaagctgttcttgaacatttttttcgtcattatc

SEQ ID NO: 1994 - DNA, 734 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggatgcattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacattttttttcgtcattatcttagttaaccg

SEQ ID NO: 1995 - DNA, 736 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacattcctcaattcttgtgtcataccatggatggttagttcatcccggcttttttgtttgtcattggaagttctttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttattttatttaataagttcaagaaaaatggaatctttatacttcagataaagctgttcttgaacattttttttcgtcattatctagttaaccg

SEQ ID NO: 1996 - DNA, 737 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacagcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttcgtcattatcttagttaaccg

SEQ ID NO: 1997 - DNA, 737 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacagcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttcgtcattatctagttaaccg

SEQ ID NO: 1998 - DNA, 630 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaaatcatttatgttttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttattatttaataagttcaagaaaaatggaatctttatacttcagataaagctgttcttgaacatttttttt

SEQ ID NO: 1999 - DNA, 726 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggatttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttgtcattatc

SEQ ID NO: 2000 - DNA, 720 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacactgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatactcagataaagctgttcttgaacattttttttgtca

SEQ ID NO: 2001 - DNA, 721 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacatttttttgtcattatc

SEQ ID NO: 2002 - DNA, 740 bp, Artificial
  Glycine max FAD3A mutation created with TALEN pair GmFAD3_T02.1
  misc_feature (473): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtggggcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaatgtgaagttataactattaacttttgactaaacttgaaaaaattcacatttttgntgtggaaccaaatctgatttgagaaccaagttgattttgatggattttgcaggagaattagccacagaactcaccatcaaaattcatggacacattgagaaggatgaatcctgggttccagtatgtgattaactacttcctctatagttaatttttcgattcaatttaaatttatttatttaataagttcaagaaaaaagggaatctttatacttcagataaagctgttcttgaacatttttttagtcattatcttagttaaccgag

SEQ ID NO: 2003 - DNA, 742 bp, Artificial
  Glycine max FAD3A mutation created with TALEN pair GmFAD3_T02.1
  misc_feature (687): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacatgcattcctcaattcttgtgccataccatggatggttagttcatcccggcttttttgtttgtcattggaagttctttttattgattcaatttttatagcgtgttcggaaacgcgtttcagaaaattaatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaaacttgaaaaaaactcacatttttgatgtggaaccaaatctgatttgagaaccaagttgattttgatggattttgcaggagaattagccacagaactcaccatcaaaagtcatggacacattgagaaggatgaatcctgggttccagtatgtgattaacctacttcctctatagttatttttgattcaattaatttatttatttataagttcaagaaaaatggaatctttntacttcagataaagctgttcttgaacattttttttcgtcattatctagttaaccg

SEQ ID NO: 2004 - DNA, 695 bp, Artificial
  Glycine max FAD3A mutation created with TALEN pair GmFAD3_T02.1
  misc_feature (286): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggagcgcagcgagtcagtgagcgaggaagcggaagagcgcccaatacgcaaaccgcctcttgcattcctcaattcttgtgccataccatggatggttagttcatcccggcttttttgtttgncattggaagttcttttattgattcaatttttaatagcgtgttcggaaacgcgtttcagaaaataatgaaatacatcttgaatctgaaagttataacttttagcttcattgtcattgaaagttcttttattaattatatttttattgcgtgtttggaatccatttgagaaataagaaatcacgtttaaaatgtgaaagttataactattaacttttgactaaacttgaaaaaaattcatcattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaatt

SEQ ID NO: 2005 - DNA, 727 bp, Artificial
  Glycine max FAD3A mutation created with TALEN pair GmFAD3_T02.1
  misc_feature (675): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggagcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaatttatttatttataagttcaagaaaatggaatctttntacttcagataaagctgttcttgaacattttttttcgtcattatctagttaa

SEQ ID NO: 2006 - DNA, 815 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatgcaaatatttcttgtcaaaaatgctccactgacgttccataaattcccctcggtatccaattagagtctcatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaatcacatttttgatgtggaaccaaatctgatttgagaaccaagttgattttgatggattttgcaggagaattagccacagaactcaccatcaaaatcatggacacattgagaagggatgaatcctgggttccagtatgtgattactacttcctctatagttattttttggattcaattaattttattttatttaataagttcaagaaaaaggaatcttttatacttcagataaatgctgttcttgaaacattttttttcgtcattatctttagtt

SEQ ID NO: 2007 - DNA, 690 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacttgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggatgaattagccacagaactcaccatcaaaatcatggacacattgagaaggatgaatcctgggttccagtatgtgattaactactcctctatagttattttgattcaattaaattttatttatttaataagttcaagaaaaatggaatctttataacttcag

SEQ ID NO: 2008 - DNA, 671 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaacctacttcctctatagttatttttgattcaattaaatttatttatttaataagttcaagaaaaaggaa

SEQ ID NO: 2009 - DNA, 667 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcctcaaattcttgtgccataccatggatggttagttcatccccggctttttttgttgcattggaagttctttttattgatcaatttttatagcggttcggaaacgcgtttcagaaaataatgaaaatacatcttgaatctgaaagttataacttttagcttcattgtcattgaaagttcttttattaattatatttttatgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaat

SEQ ID NO: 2010 - DNA, 726 bp, Artificial; identical to SEQ ID NO: 1656
  Glycine max FAD3A mutation created with TALEN pair GmFAD3_T02.1

SEQ ID NO: 2011 - DNA, 716 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacttgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacatttttttt

SEQ ID NO: 2012 - DNA, 742 bp, Artificial
  Glycine max FAD3A mutation created with TALEN pair GmFAD3_T02.1
  misc_feature (683): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacagcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttntacttcagataaagctgttcttgaacattttttttcgtcattatctagttaaccgagaa

SEQ ID NO: 2013 - DNA, 736 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacatcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttattttatttaataagttcaagaaaaatggaatctttatacttcagataaagctgttcttgaacatttttttcgtcattatctagttaaccg

SEQ ID NO: 2014 - DNA, 576 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacttgcattcctcaattcttgtgccataccatggatggttagttcatcccggcttttttgtttgtcattggaagttctttttattgattcaatttttatagcgtgttcggaaacgcgtttcagaaaattaatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggatttgcaggatgaattagccacagaactcaccatcaaaatcatggacacattga

SEQ ID NO: 2015 - DNA, 715 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttgtca

SEQ ID NO: 2016 - DNA, 691 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctgggcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaataagaaatcacgtttaaatgtgaagttataactattaacttttgactaaacttgaaaaaatcacatttttgatgttggaaccaaatctgatttgagaaccaatgttgattttgatggattttgcaggagaatttagccacagaactcaccatcaaaatcatggacacattgagaaggatgaatcctgggttccagtatgtgattaactacttcctctatagttattttgattcaattaaatttatttatttaataagttcaagaaaaaagggaatctttatacttcagataaagctg

SEQ ID NO: 2017 - DNA, 741 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacatgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaatggaaatctttataacttcagataaaagctgttcttgaacattttttttgtcattatctaagttaaccg

SEQ ID NO: 2018 - DNA, 736 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaattatttatttaataagttcaagaaaaatggaatctttatacttcagataaagctgttcttgaacattttttttcgtcattatctagttaacc

SEQ ID NO: 2019 - DNA, 730 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacagcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacattttgactaaacttgaaaaaactcacattttgatgtggaaccaaatctgatttgagaaccaagttgattttgatggatttgcaggagaattagccacagaactcaccatcaaaatcatggacacattgagaaggatgaatcctgggttccagtatgtgattaactacttcctctatagttatttttgattcaattaaatttatttatttaaataagttcaagaaaaatggaatctttatacttcagataaagctgttctttgaacatttttttcgtcattatct

SEQ ID NO: 2020 - DNA, 808 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagactggtgggacacgaccacttctgcgctcggcccttccggctggctggtttattgctgataaatctggagccggtgagcgtgggtctcgcggtatcattgcagcactggggccagatggtaagcccttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatattttattgcgtgtttggaatcccatttgagaaataagaaatcacgtttaaaatgtgaaagttataactattaacttttgactaaacttgaaaaaaactcacatttttgtgtggaccaaatctgattgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaattaagttcaagaaaaatggaatctttatacttcagaataaa

SEQ ID NO: 2021 - DNA, 733 bp, Artificial
  Glycine max FAD3A mutation created with TALEN pair GmFAD3_T02.1
  misc_feature (679): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggatgcattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattatgccacagaactcaccatcaaaatcatggacacattgagaaggatgaatcctgggttccagtatgtgattaactacttcctctatagttatttttgattcaattaaatttatttatttaatagttcaagaaaaatggaagtctttntacttcagataaagctgttcttgaacattttttttcgtcattatctagttaacc

SEQ ID NO: 2022 - DNA, 721 bp, Artificial
  Glycine max FAD3A mutation created with TALEN pair GmFAD3_T02.1
  misc_feature (676): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacactcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttntacttcagataaagctgttcttgaacattttttttgtcattatct

SEQ ID NO: 2023 - DNA, 618 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaaagttataactattaacttttgactaaacttgaaaaaatcacatttttgatgtggaaccaaatctgattgagaaccaagttgattttgatggattttgcaggagaatttagccacagaactcaccatcaaaatcatggacacattgagaaggatgaatcctgggttccagtatgtgattaactacttcctctatagttatttttgattcaattaaatttatttatttaataagttcaagaaaaaaatggaatctttatacttcag

SEQ ID NO: 2024 - DNA, 737 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacattcctcaattcttgtgccataccatggatggttagttcatcccggcttttttgtttgtcattggaagttctttttattgattcaatttttatagcgtgttcggaaacgcgtttcagaaaataatgaaaatacaacttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttcgtcattatctagttaacc

SEQ ID NO: 2025 - DNA, 691 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggttcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaatgtgaaagttataactattaacttttgactaaacttgaaaaaattcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttcgattcaattaaatttatttatttaataagttcaagaaaaaagggaatctttatacttcagataaa

SEQ ID NO: 2026 - DNA, 699 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggatcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaataagaaatcacgtttaaaaatgtgaaagttataactattaacttttgactaaacttgaaaaaatcacatttttgatgtggaaccaaatctgatttgagaacccaagttgatttttgatgggattttgccaggagaatttagccacagaactcaccatcaaaatcatggacacattgagaaggatgaatcctgggttccagtatgtgattaactacttcctctatagttattttgattcaattaaaatttatttatttaataagttcaagaaaaaaagggaatctttatacttcagataaagctg

SEQ ID NO: 2027 - DNA, 711 bp, Artificial
  Glycine max FAD3A mutation created with TALEN pair GmFAD3_T02.1
cactgctttgttatgccaacctcatttcatttggctttagacaacttaaatttgagatctttattatgttttttgcttatatggtaaagtgattcattcttcacattgaattgaacagtggccatggaagcttttcagacagcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaaattgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttattaataagttcaagaaaaagggaatcttatacttcagataaagctgttcttgaacatttttttagtcattatcttagttaaccgag

SEQ ID NO: 2028 - DNA, 735 bp, Artificial
  Glycine max FAD3A mutation created with TALEN pair GmFAD3_T02.1
  misc_feature (680): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagtatttttgattcaattaaatttatttatttaataagttcaagaaaaatggaatctttntacttcagataaagctgttcttgaacattttttttcgtcattatctagttaaccg

SEQ ID NO: 2029 - DNA, 660 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggatggttagttcatcccggcttttttgtttgtcattggaagttcttttattgattcaatttttatagcgtgttcggaaacgcgtttcagaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgattgagaaccaagttgattttgatggattttgcaggagaatttagccacatgaactcaccatcaaaatcatggacacattgagaaggatgaatcctgggttccagtatgtgattaactacttcctctatagttatttttgattcaattaatttatttatttaataagttcaagaaaaaatggaatctttatacttcagataaagctgtcttgaacattttttttgtcattatctagtttaaccgagaag

SEQ ID NO: 2030 - DNA, 510 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacagtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttatacttttagcttcattgtcattgaaagttcttttattaattata

SEQ ID NO: 2031 - DNA, 699 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacagcattcctcaattcttgtgccataccatggatggttagttcatcccggcttttttgtttgtcattggaagttctttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttc

SEQ ID NO: 2032 - DNA, 735 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtggcattcctcaattcttgtgccataccatggatggttagttcatcccggcttttttgtttgtcattggaagttcttttattgatcaatttttatagcgtgttcggaaacgcgtttcagaaaataatgaaatacatcttgaatctgaaaagttataacttttagcttcattgtcattgaaagttcttttattaattatatttttattgcgtgtttggaatcccatttgagaaataagaaatcacgtttaaaaatgtgaaagttataactattaacttttgactaaacttgaaaaaattcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaagggaatctttatacttcagataaagctgttcttgaacattttttttagtcattatcttagttaaccgag

SEQ ID NO: 2033 - DNA, 647 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacgcattcctcaattcttgtgccataccatggatggttagttcatcccggcttttttgtttgtcattggaagttctttttattgattcaatttttatagcgtgttcggaaacgcgtttcaggaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttattt

SEQ ID NO: 2034 - DNA, 735 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaatgtgaaagttataactattaacttttgactaaacttgaaaaaattcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaagggaatctttatacttcagataaagctgttcttgaacattttttttagtcattatcttagttaaccgag

SEQ ID NO: 2035 - DNA, 583 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcgctggagacggtccagcggctgttgccggtgctgtgccaggcccacggcttgaccccggagcaggtggtggccatcgccagccacgatggcggcaaacagccgctggaccattcctcaattcttgtgccataccatggatggtttagttcatcccgggcttttttgtttgtcattgggaagttctttttattgattcaatttttatagcgtgttcggaaacgcgtttcagaaaataatgaaatacatcttgaatctgaaagttataacttttagcttcattgtcattgaaagttcttttattaattatattttattgcgtgtttggaatcccatttgagaaataagaaatcacgtttaaaatgtgaaagtataactattaacttttgactaaatcttgaaaaaaactcaca

SEQ ID NO: 2036 - DNA, 647 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggactgcattcctcaattcttgtgccatatccatggatggttagttcatcccggcttttttgtttgtcattggaagttctttttattgattcaatttttatagcgtgttcggaaacgcgtttcagaaaataatgaaaatacatctgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagtttgattttgatggattttgctaggagaattagccacagaactcaccatcaaaatcatggacacattgagaaggatgaatcctgggttccagtatgtgattaactacttcctctatagttatttttgattcaattaaattta

SEQ ID NO: 2037 - DNA, 734 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacaacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacatttttttgtcattatctaagttaaccg

SEQ ID NO: 2038 - DNA, 711 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatgtattttgcaggagaattagccacagaactcaccatcaaaatcatggacacattgagaaggatgaatccgggttccagtatgtgattaactacttcctctatagttatttttgattcaattaaatttatttatttaataagttcaagaaaaaaggaatctttatacttcagataaagctgttcttgaacatttttttt

SEQ ID NO: 2039 - DNA, 545 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttcacattgagatctttattatgttttttgtttgtcattggaagttcttttattgattcaatttttatagcgtgttcggaaacgcgtttcagaaataatgaaatacatcttgaatctgaaagttataacttttagcttcattgtcattgaaagttcttttattaattatatttttattgcgtgtttggaatcccatttgagaaataagaaatcacgtttaaaatgtgaagttataactattaacttttgactaaacttgaaaaaatcacattttgatgtggaaccaaatctgatttgagaaccaagttgatttttgatggatttttgcaggagaattagccacagaacttcatcaaatcaatgatgcacattgagaaggatgaatcctgggttccagtat

SEQ ID NO: 2040 - DNA, 621 bp, Artificial
  Glycine max FAD3A mutation created with TALEN pair GmFAD3_T02.1
cactgctttgttatgcctacctcatttcatttggctttagacaacttaaatttgagatctttattatgtttttttgcttatatggtaaagtgattcattcttcacattgaattgaacagtggccatggaagcttttcagacagcccttttctaaatagcctggtggaacagccctttttcagacattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaagtcatggacacattgagaaggatgaatcctgggttccagtatgtgattaa

SEQ ID NO: 2041 - DNA, 721 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacactcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttgtcattatct

SEQ ID NO: 2042 - DNA, 477 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatccagcggctgttgccggtgctgtgccaggcccacggcttgaccccggagcaggtggtggccatcgccagcaatattggtggcaagcaggcgctggagacggtgcaggcgctgttgccttgcattcctcaattcttgtgccataccatggatggttagttcatcccgggcttttttgtttgtcattgggaagttctttttattgattcaatttttatagcgtgttcggaaacgcgtttcagaaaataatgaaatacatcttgaatctgaaagttataacttttagcttcattgtcattgaaagttc

SEQ ID NO: 2043 - DNA, 738 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacagcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttgtcattatctagttaaccga

SEQ ID NO: 2044 - DNA, 727 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttcgtcattatct

SEQ ID NO: 2045 - DNA, 678 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttcttttattaattatatttttattgcgtgtttggaatcccatttgagaaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaaatcatggacacattgagaaggatgaatcctgggttccagtatgtgattaactacttcctctatagttatttttgattcaattaaatttatttatttaataagttcaagaaaaaaggaaatctttatacttcagataaagctgttcttgaacatttttttt

SEQ ID NO: 2046 - DNA, 737 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacattgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttcgtcattatctagttaaccg

SEQ ID NO: 2047 - DNA, 887 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgtgttgacgggtgtcggggctggcttaactatgcggcatcagagcagattgtactgagagtgcaccatatgcggtgtgaaataccgcacagatgcgtaaggagaaaataccgcatcagatcgcccttcccattcctcaattcttgtgccataccatggatggttagttcatcccggctttttgtttgtcattggaagttcttttattgattcaatttttatagcgtgttcggaaacgcgtttcagaaaataatgaaatacatcttgaatctgaaaagttataacttttagctcattgtcattgaaagttcttttattaattatatttttattgcgtgtttggaatcccatttgagaaataagaaatcacgtttaaaatgtgaaagttataactattaactttgactaaaactttgaaaaaaactcacatttttgatgtggaaccaaatctgattttgagaaccaagttgatttttgatggattttgcaggagaattagccacagaactcaccatcaaaatcatggacacattgagaaggatgaatcctgggttccagtatgtgattaagctacttcctcatatatgttatttttgattcaattttgaaattttcattttaattttaattaagtttcaaatgaaaaaagggtaaagaagtatcttttataactttccagaataaagctgttcttgaaacatttttttcgtcatatctt

SEQ ID NO: 2048 - DNA, 734 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttgtcattatcttagttaaccg

SEQ ID NO: 2049 - DNA, 735 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacgcattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttcgtcattatctagttaacc

SEQ ID NO: 2050 - DNA, 460 bp, Artificial
  Glycine max FAD3A mutation created with TALEN pair GmFAD3_T02.1
  misc_feature (458): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaagttcttttattaattatatttttattgcgtgtttggaatcccatttgagaatagaatcacgtttaaatgtgaagttataactattaacttttgactaaacttgaaaaaattcacatttttgntg

SEQ ID NO: 2051 - DNA, 724 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacactgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggatttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatactcagataaagctgttcttgaacatttttttgtcattatct

SEQ ID NO: 2052 - DNA, 694 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacagcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagc

SEQ ID NO: 2053 - DNA, 630 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttt

SEQ ID NO: 2054 - DNA, 737 bp, Artificial
  Glycine max FAD3A mutation created with TALEN pair GmFAD3_T02.1
  misc_feature (682): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttntacttcagataaagctgttcttgaacattttttttcgtcattatctagttaaccg

SEQ ID NO: 2055 - DNA, 733 bp, Artificial
  Glycine max FAD3A mutation created with TALEN pair GmFAD3_T02.1
  misc_feature (681): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttntacttcagataaagctgttcttgaacattttttttcgtcattatctagttaa

SEQ ID NO: 2056 - DNA, 733 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacgcattcctcaattcttgtgccataccatggatggttagttcatcccggcttttttgtttgtcattggaagttctttttattgattcaatttttatagcgtgttcggaaacgcgtttcaggaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacatttttttgtcattatcttagttaaccg

SEQ ID NO: 2057 - DNA, 682 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaataccatggatggttagttcatcccggcttttttgtttgtcattggaagttcttttattgattcaatttttatagcgtgttcggaaacgcgtttcagaaataatgaaatacatcttgaatctgaaagttataacttttagcttcattgtcattgaaaagttcttttattaattatatttttattgcgtgtttggaatcccatttgagaaatagaaatcacgtttaaatgtgaagttataactattaacttttgactaaacttgaaaaaatcacatttttgatgtggaacccaaatctgatttgagaaccaagttgatttttgatggatttttgcaggagaattagcccacagaactcaccatcaaaatcatggacacattgagaaggatgaatcctgggttccagtatgtgattaactacttcctctatagttattttgattcaattaaaatttatttatttaataagttcaagaaaaagggaatctttatacttcagataaagctgttcttgaacattttttttgtca

SEQ ID NO: 2058 - DNA, 534 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacagtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgcattcctcaattcttgtgccataccatggatggttagttcatcccggctttttgttgtcattggaagttcttttattgattcaattttatagcgtgttcggaaacgcgtttcagaaaatatgaatacatcttgaatctgaaagttatactttagcttcattgtcattgaaagttcttttattaattatattttattgcgtgtttggaatcccatttgag

SEQ ID NO: 2059 - DNA, 666 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaa

SEQ ID NO: 2060 - DNA, 718 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttattaataagttcaagaaaaaggaatctttatacttcagataaagctgttcttgaacatttttttgtcattatcttagttaaccgag

SEQ ID NO: 2061 - DNA, 738 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttcgtcattatctagttaaccg

SEQ ID NO: 2062 - DNA, 736 bp, Artificial
  Glycine max FAD3A mutation created with TALEN pair GmFAD3_T02.1
  misc_feature (682): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacagcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggatttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttntacttcagataaagctgttcttgaacattttttttcgtcattatctagttaacc

SEQ ID NO: 2063 - DNA, 660 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacatcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggatgaattgatgccacagaacttcaccatcaaaatcatggacaacattgagaaggatgaatcctgggttccagtatgtgattaactacttcctctatagttatttttgattcaattaaatttatttatttaat

SEQ ID NO: 2064 - DNA, 733 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttgtcattatctagttaaccga

SEQ ID NO: 2065 - DNA, 781 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacactattgctggcgatggccaccacctgctccggggtcaagccgtgggcctggcacagcaccggcaacagcgcctggaccgtctccagcgcctgcttgccaccaaactcaattcttgtgccataccatggatggttagttcatcccggcttttttgtttgtcattggaagttcttttattgattcaatttttatagcgtgttcggaaacgcgtttcagaaataatgaaatacatcttgaatctgaaagttataacttttagcttcattgtcattgaaaagttcttttattaattatatttttattgcgtgttggaatcccatttgagaaataagaaatcacgtttaaaatgtgaaagttataactattaactttgactaaacttgaaaaaagtcacatttttgatgtggaaccaaatctgatttgagaaccaagttgattttgatggattttgcaggagaattagccacagaactcaccatcaaaatcatggacacattgagaaggatgaatcctgggttccagtatgtgatttaactacttcctctatagttattttttgattcaattaattttatttatttaataagttcaagaaaaacggaatctttatac

SEQ ID NO: 2066 - DNA, 570 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggattgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatgggcacat

SEQ ID NO: 2067 - DNA, 688 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttcgtaatcatggtcatagcattggatcgaatcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatac

SEQ ID NO: 2068 - DNA, 711 bp, Artificial
  Glycine max FAD3A mutation created with TALEN pair GmFAD3_T02.1
  misc_feature (677): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacagcattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttataagttcaagaaaaaggaatctttntacttcagataaagctgttcttgaacattttttt

SEQ ID NO: 2069 - DNA, 734 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacaattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttcgtcattatctagttaacc

SEQ ID NO: 2070 - DNA, 708 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaataagaaatcacgtttaaaatgtgaagttataactattaacttttgactaaacttgaaaaaattcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttattatttaataagttcaagaaaaaagggaatctttatacttcagataaagctgttcttgaacattttttt

SEQ ID NO: 2071 - DNA, 715 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacactgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggatttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacatttttttt

SEQ ID NO: 2072 - DNA, 689 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaaatgtgaaagttataactattaacttttgactaaacttgaaaaaattcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaaggaatctttatacttcagataaagc

SEQ ID NO: 2073 - DNA, 735 bp, Artificial
  Glycine max FAD3A mutation created with TALEN pair GmFAD3_T02.1
  misc_feature (680): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttntacttcagataaagctgttcttgaacattttttttcgtcattatctagttaaccg

SEQ ID NO: 2074 - DNA, 665 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctgggcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaataagaaatcacgtttaaaatgtgaagttataactattaacttttgactaaacttgaaaaaattcacatttttgatgtggaaccaaatctgatttgagaaccaagttgattttgatggattttgcaggagaatttagccacagaactcaccatcaaaatcatggacacattgagaaggatgaatcctgggttccagtatgtgattaactacttcctctatagttatttttcgattcaattaaatttatttatttaataagttcaagaaaaaa

SEQ ID NO: 2075 - DNA, 454 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacttgctggcgatggccaccacctgctggggggtcaagccgtgggcctggcacagcaccggcaacagccgctggaccgtctccagcgcctgcttgccacctgccattgctggcgatggccaccacctgctggggggtcaatgccgtgggcctggcacagcaccggcaacagccgctggaccgtctccatggatggttagttcatcccggctttttgtttgtcattggaagttcttttattgattcaattttatagcgtgttcggaaacgctgtttcagaaaattaa

SEQ ID NO: 2076 - DNA, 715 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacataccatggatggttagttcatcccggctttttttgttttgtcattggaagttcttttattgattcaatttttatagcgtgttcggaaacgcgtttcagaaaataatgaaatacatcttgaatctgaaagttataacttttagcttcattgtcattgaaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttattaataagttcaagaaaaaaggaatcttatacttcagataaagctgttcttgaacatttttttgtcattatcttagttaaccgag

SEQ ID NO: 2077 - DNA, 730 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaattgtgaaagttataactattaacttttgactaaacttgaaaaaatcacatttttgatgtggaaccaaatctgattttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaaagaaaaaagggaatctttatacttcagataaagctgttcttgaacatttttttagtcattatcttagttaaccgag

SEQ ID NO: 2078 - DNA, 733 bp, Artificial; identical to SEQ ID NO: 1580
  Glycine max FAD3A mutation created with TALEN pair GmFAD3_T02.1

SEQ ID NO: 2079 - DNA, 630 bp, Artificial
  Glycine max FAD3A mutation created with TALEN pair GmFAD3_T02.1
  misc_feature (464): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaataagaatcacgtttaaatgtgaagttataactattaacttttgactaaacttgaaaaaattcacatttttgntgtggaaccaaatctgatttgagaaccaatgttgattttgatggattttgcaggagaatttagccacagaactcaccatcaaaatcatggacacattgagaaggatgaatcctgggttccagtatgtgattaactacttcctctatagttatttttcgattcaatt

SEQ ID NO: 2080 - DNA, 841 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacataactgggcaacaatgctctccagcgccggcctgccgccgccattgctggcgatggccaccacctgctgaggggtcaagccgtgggcctggcacagcaccggcaacagccgctggaccttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatattttattgcgtgtttggaatccatttgagaaataagaaatcacgttaaatgtgaaagttataactattaacttttgactaaaacttgaaaaaaatcacattttgatgtggaaccaaatcatgatttgagaaccaagttgattttgatggattttgcaggagaattagccatcagaactcaccatcaaaatcatggacacattgagaaggatgaatcctgggttccagtatgtgattaactacttcctctatagttatttttgattcaattaaatttatttatttaataagttcaagaaaaatggaatctttatacttcagaataaagtctgttcttgaacaatttttttgtca

SEQ ID NO: 2081 - DNA, 739 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacattttttttcgtcattatcttagttaaccg

SEQ ID NO: 2082 - DNA, 739 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacacattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatatgttatttttgattcaattaaatttattttatttaataagttcaagaaaaatggaatctttatacttcagataaagctgttcttgaacattttttttcgtcattatctagttaaccg

SEQ ID NO: 2083 - DNA, 714 bp, Artificial
  Glycine max FAD3A mutation created with TALEN pair GmFAD3_T02.1
  misc_feature (265): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacattcctcaattcttgtgccataccatggatggttagttcatcccggcttttttgttgtcattggaagttctttttattgattcaatttttatagcgngttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttcgt

SEQ ID NO: 2084 - DNA, 723 bp, Artificial
  Glycine max FAD3A mutation created with TALEN pair GmFAD3_T02.1
  misc_feature (687): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttcgtaatcatggtcatagcattggatcgaatcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaactcacattttgatgtggaaccaaatctgatttgagaaccaagttgattttgatggattttgcaggagaattagccacagaactcaccatcaaaagtcatggacacattgagaaggatgaatcctgggttccagtatgtgattaactacttcctctatagttatttttgattcaattaaatttatttattaataagttcaagaaaaatggaatctttntacttcagataaagctgttcttgaacattttttttt

SEQ ID NO: 2085 - DNA, 661 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagccttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaatgtgaaagttataactattaactttgactaaacttgaaaaaatcacatttttgatgtggaaccaaatctgatttgagaaccaatgttgattttgatggattttgcaggagaatttagccacagaactcaccatcaaaatcatggacacattgagaaggatgaatcctgggttccagtatgtgattaactacttcctctatagttattttgattcaattaaatttatttatttaataagttcaagaaaaa

SEQ ID NO: 2086 - DNA, 694 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtggggcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaaaggaatctttatacttcagataaagctg

SEQ ID NO: 2087 - DNA, 742 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacatgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaactcacattttgatgtggaaccaaatctgatttgagaaccaagttgattttgatggattttgcaggagaattagccacagaactcaccatcaaaagtcatggacacattgagaaggatgaatcctgggttccagtatgtgattaacctacttcctctatagttatttttgattcaattaaatttattttatttaataagttcaagaaaaatggaatctttatacttcagataaagctgttcttgaacattttttttcgtcattatctagttaaccg

SEQ ID NO: 2088 - DNA, 698 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaatgtgaaagttataactattaacttttgactaaacttgaaaaaattcacatttttgatgtggaaccaaatctgatttgagaaccaatgttgattttgatggattttgcaggagaatttagccacagaactcaccatcaaaatcatggacacattgagaaggtatgaatcctgggttccagtatgtgattaactacttcctctatagttattttcgattcaattaaatttatttatttaataagttcaagaaaaagggaatctttatacttcagataaatgctg

SEQ ID NO: 2089 - DNA, 713 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtggggcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaatgtgaaagttataactattaacttttgactaaacttgaaaaaattcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaaggaatctttatacttcagataaagctgttcttgaacattttttt

SEQ ID NO: 2090 - DNA, 736 bp, Artificial; identical to SEQ ID NO: 1652
  Glycine max FAD3A mutation created with TALEN pair GmFAD3_T02.1

SEQ ID NO: 2091 - DNA, 732 bp, Artificial
  Glycine max FAD3A mutation created with TALEN pair GmFAD3_T02.1
  misc_feature (672): n is a or c or t or g
cactgctttgttatgcctacctcatttcatttggctttagacaacttaaatttgtagatctttattatgttttttgcttatatggtaaagtgattcattcttcacattgaattgaacagtggccatggaagcttttcagacagcccttttctaaatagcctggtgggatgcattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaagganctttatacttcagataaagctgttcttgaacattttttttgtcattatcttagttaaccg

SEQ ID NO: 2092 - DNA, 730 bp, Artificial
  Glycine max FAD3A mutation created with TALEN pair GmFAD3_T02.1
  misc_feature (473): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtggggcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaatgtgaaagttataactattaacttttgactaaactgaaaaaattcacatttttgntgtggaaccaaatctgatttgagaaccaagttgatttttgatggattttgcaggagaattagccacagaactcaccatcaaaattcatggacacattgagaaggatgaatcctgggttccagtatgtgattaactacttcctctatagttatttttcgattcaattaaatttatttatttaataagttcaagaaaaaagggaatctttatacttcagataaagctgttcttgaacatttttttagtcattatcttag

SEQ ID NO: 2093 - DNA, 710 bp, Artificial
  Glycine max FAD3A mutation created with TALEN pair GmFAD3_T02.1
  misc_feature (676): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacatcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttntacttcagataaagctgttcttgaacattttttt

SEQ ID NO: 2094 - DNA, 396 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacaatggccaccacctgctggggggtcaagccgtgggcctggcacagcaccggcaacagccgctggaccgtctccagcgcctgcttgccaccgccattgctggcgatggccaccacctgctgggggctcaagccgtgggcctggcacagcaccggcaacagccgctggaccgtctccagcgcctgcttgccaccgcattcctcaattcttgtgccataccatggatgg

SEQ ID NO: 2095 - DNA, 705 bp, Artificial
  Glycine max FAD3A mutation created with TALEN pair GmFAD3_T02.1
  misc_feature (639): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcccttttcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttcttttattaattatatttttattgcgtgtttggaatcccatttgagaaataagaaatcacgtttaaaatgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttntttaataagtctaagaaaaaaagggaatcttttactcagataaagctgttcttgaacatttttttt

SEQ ID NO: 2096 - DNA, 735 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggattgcattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaaggaatctttatacttcagataaagctgttcttgaacattttttttcgtcattatcttagttaaccg

SEQ ID NO: 2097 - DNA, 730 bp, Artificial
  Glycine max FAD3A mutation created with TALEN pair GmFAD3_T02.1
  misc_feature (676): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaatttatttatttataagttcagaaaatggaatctttntacttcagataaagctgttcttgaacattttttttcgtcattatctagttaacc

SEQ ID NO: 2098 - DNA, 666 bp, Artificial; identical to SEQ ID NO: 2059
  Glycine max FAD3A mutation created with TALEN pair GmFAD3_T02.1

SEQ ID NO: 2099 - DNA, 699 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacattcctcaaattcttgtgccataccatggatggttagttcatccccggcttttttgttgcattggaagttctttttattgatcaatttttatagcggttcggaaacgcgtttcagaaaataatgaaaatacatcttgaatctgaaagttataacttttagcttcattgtcattgaaagttcttttataattatatttttatgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaac

SEQ ID NO: 2100 - DNA, 734 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaacctacttcctctatagttatttttgattcaattaaatttatttatttaataagttcaagaaaaatggaatctttatacttcagataaagctgttcttgaacatttttttcgtcattatcttagttaaccg

SEQ ID NO: 2101 - DNA, 712 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacattttttt

SEQ ID NO: 2102 - DNA, 666 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggttcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaataagaaatcacgtttaaaatgtgaagttataactattaacttttgactaaacttgaaaaaattcacatttttgatgttggaaccaaatctgatttgagaaccaagttgattttgatggattttgcaggagaatttagccacagaactcaccatcaaaatcatggacacattgagaaggatgaatcctgggttccagtatgtgattaactacttcctctatagttatttttgattcaattaaatttatttatttaataagttcaagaaaaaa

SEQ ID NO: 2103 - DNA, 701 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtggggtggtggccatcgccagcaatattggtggaactgaaaatggagtgcacatcacaaagattgaatcctcctcaattcttgtgccataccatggatggttagttcatcccggcttttttgtttgtcattggaagttcttttattgattcaatttttatagcgtgttcggaaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatgggacacattgagaaggatgaatcctgggttccagtatgtgattaactacttcctctatagttatttttgattcaattaaa

SEQ ID NO: 2104 - DNA, 691 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctgggcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaatttagccacagaactcaccatcaaaatcatggacacattgagaaggatgaatcctgggttccagtatgtgattaactacttcctctatagttattttgattcaattaaatttatttatttaataagttcaagaaaaaagggaatctttatacttcagataaagctg

SEQ ID NO: 2105 - DNA, 735 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacagcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttcgtcattatctagttaacc

SEQ ID NO: 2106 - DNA, 713 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtggggcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaatgtgaaagttataactattaacttttgactaaacttgaaaaaattcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaagggaatctttatacttcagataaagctgttcttgaacattttttt

SEQ ID NO: 2107 - DNA, 721 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacatctccagcgcctgcttgccaccattattgctggcgatggccaccacctgctggggggtcaagccgtgggcctggcacagcaccggcaacagcgtcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatattttattgcgtgttggaatcccatttgagaaataagaatcacgtttaaatgtgaaagttataactattaactttgactaaacttgaaaaaagtcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttt

SEQ ID NO: 2108 - DNA, 746 bp, Artificial
  Glycine max FAD3A mutation created with TALEN pair GmFAD3_T02.1
  misc_feature (249); (690): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacattcctcaattcttgtgccataccatggatggttagttcatcccggcttttttgtttgtcattggaagttctttttattgnttcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttcgattcaattaaatttaatttttatttaattaagttcaagaaaaataggaaagatcttttntacttcagataaagctgttcttgaacattttttttcgtcattatctagttaaccga

SEQ ID NO: 2109 - DNA, 730 bp, Artificial
  Glycine max FAD3A mutation created with TALEN pair GmFAD3_T02.1
  misc_feature (645): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggagcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagtatttttgttcaattaaatttatttntttataagttcaagaaaaatggaatctttatacttcagataaagctgttcttgaacattttttttcgtcattatctagttaaccg

SEQ ID NO: 2110 - DNA, 736 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacagcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacattttttttcgtcattatcttagttaaccg

SEQ ID NO: 2111 - DNA, 725 bp, Artificial; identical to SEQ ID NO: 1557
  Glycine max FAD3A mutation created with TALEN pair GmFAD3_T02.1

SEQ ID NO: 2112 - DNA, 737 bp, Artificial; identical to SEQ ID NO: 1997
  Glycine max FAD3A mutation created with TALEN pair GmFAD3_T02.1

SEQ ID NO: 2113 - DNA, 744 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgaacaggaacttgaactcggtcacgctggaggggtacaccttcctgcattcctcaattcttgtgccataccatggatggttagttcatcccggcttttttgtttgtcattggaagttcttttattgattcaatttttatagcgtgttcggaaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaactttgactaaacttgaaaaaatcacattttgatgtggaaccaaatctgatttgagaaccaagttgattttgatggattttgcaggagaattagccacagaactcaccatcaaaatcatggacacaattgagaaggatgaatcctgggttccagtatgtgattaactacttcctctatagttatttttgattcaattaaatttatttatttaataagttcaagaaaaaagggaatctttatacttcagataaagctg

SEQ ID NO: 2114 - DNA, 694 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggcataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcttgaaaagtttctttttattaattatatttttatttgcggttttggaaatcccatttgagaaataagaaatcacgtttaaaaatgtgaaagttataactattaacttttgactaaacttgaaaaaactcacatttttgatgtggaaccaaaatctgattttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttattaataagttcaagaaaaaggaatcttatacttcagataaagctgttcttgaacattttttt

SEQ ID NO: 2115 - DNA, 722 bp, Artificial
  Glycine max FAD3A mutation created with TALEN pair GmFAD3_T02.1
  misc_feature (677): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggagcattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttntacttcagataaagctgttcttgaacattttttttgtcattatct

SEQ ID NO: 2116 - DNA, 731 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacaccgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttcgtcattatctag

SEQ ID NO: 2117 - DNA, 734 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacactattgctggcgatggccaccacctgctccggggtcaagccgtgggcctggcacagcaccggcaacagcgcctggaccgtctccagcgcctgcttgccaccaactcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatattttattgcgtgtttggaatcccatttgagaaataagaaatcacgtttaaaatgtgaaagttataactattaactttgactaaacttgaaaaaatcacatttttgatgtggaaccaaatctgatttgagaaccaagttgattttgatggatttgcaggagaattagccacagaactcaccatcaaaatcatggacacattgagaaggatgaatcctgggttccagtatgtgatttaactacttcctctatagttatttttgattcaattaa

SEQ ID NO: 2118 - DNA, 736 bp, Artificial
  Glycine max FAD3A mutation created with TALEN pair GmFAD3_T02.1
  misc_feature (681): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaacctacttcctctatagttatttttgattcaattaaatttatttatttataagttcaagaaaaatggaatctttntacttcagataaagctgttcttgaacattttttttcgtcattatctagttaaccg

SEQ ID NO: 2119 - DNA, 735 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacatacaatctgctctgatgccgcatagttaagccagccccgacacccgccatgcattcctcaattcttgtgccataccatggatggttagttcatcccggcttttttgttgtcattggaagttcttttattgattcaatttttatagcgtgttcggaaaacgcgtttcagaaaataatgaaatacatcttgaatctgaaagttataacttttagcttcattgtcattgaaagttcttttattaattatatttttattgcgtgttttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacatttttttt

SEQ ID NO: 2120 - DNA, 728 bp, Artificial; identical to SEQ ID NO: 1598
  Glycine max FAD3A mutation created with TALEN pair GmFAD3_T02.1

SEQ ID NO: 2121 - DNA, 737 bp, Artificial
  Glycine max FAD3A mutation created with TALEN pair GmFAD3_T02.1
cactgcttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaaactcaccatcaaaatcatggacacattgagaaggatgaatcctgggttccagtatgtgattaactacttcctctatagttatttttgattcaattaaatttattttatttaataagttcaagaaaaataggaaatctttatacttcagataaagctgttcttgaacattttttttgtcattatctaagttaaccg

SEQ ID NO: 2122 - DNA, 736 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttcgtcattatctagttaacc

SEQ ID NO: 2123 - DNA, 598 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttcagcttcattgtcattgaaagttcttttattaattatatttttattgcgtgtttggaatcccatttgagaaataagaaatcacgtttaaaattgtgaaagttataactattaacttttggactaaacttgaaaaaactcacattttgatgtggaaccaaatctgatttgagaaccaagttgattttgatggattttcgcaggagaattagccacagaactcaccatcaaaagtcatggacacattgagaaggatgaatcctggg

SEQ ID NO: 2124 - DNA, 695 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaatgtgaaagttataactattaacttttgactaaacttgaaaaaattcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaagggaatctttatacttcagataaagctg

SEQ ID NO: 2125 - DNA, 736 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacagcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttcgtcattatctagttaaccg

SEQ ID NO: 2126 - DNA, 650 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaacctacttcctctatagttatttttgattcaatt

SEQ ID NO: 2127 - DNA, 693 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggaattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaatgtgaaagttataactattaacttttgactaaacttgaaaaaattcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttattatttaataagttcaagaaaaaaggaatctttatacttcagataaagctg

SEQ ID NO: 2128 - DNA, 673 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcaattgattcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttcttttattaattatatttttattgcgtgtttggaatccatttgagaaataagaaatcacgtttaaaatgtgaaagttataactattaacttttgactaaacttgaaaaaattcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaatggaatctttatacttcagataaagctgttcttgaacattttttttgtcattatcttagttaaccgag

SEQ ID NO: 2129 - DNA, 602 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacattcctcaattcttgtgccataccatggatggttagttcatcccggcttttttgtttgtcattggaagttcttttattgattcaatttttatagcgttgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaaactcaccatcaaaatcatggacacattgagaaggatgaatcctgggttccagtatgtga

SEQ ID NO: 2130 - DNA, 691 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggcggctccaggaagcccgacggcgccatctacaccgtgggctcccccatcgactacggcgtgatcgtggacaccaaggcctactccggcggctacaacctgcccatcggccaggccgacgaagcattcctcaattcttgtgccataccatggatggttagttcatcccggctttttgtttgtcattggaagttcttttattgattcaatttttatagcgtgttcggaaacgcgtcatcgaaaataatgaaatacatcttgaatctgaaagttataacttttagcttcattgtcattgaaagttcttttattaattatattttattgcgtgtttggaatccccatttgagaaataagaaatcacgtttaaaatgtgaaagttataactattaactttgactaaacttgaaaaaatcacatttttgatgtggaaccaaatctgatttgagaaccaagttgattttgatggattttgtcaggagaattagccacagaactcaccatcaaaatcatggacacattgagaa

SEQ ID NO: 2131 - DNA, 732 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacatttttttttccattatcttagttaacc

SEQ ID NO: 2132 - DNA, 732 bp, Artificial
  Glycine max FAD3A mutation created with TALEN pair GmFAD3_T02.1
  misc_feature (680): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtggttgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttataagttcaagaaaaatggaatctttntacttcagataaagctgttcttgaacattttttttcgtcattatctagttaa

SEQ ID NO: 2133 - DNA, 732 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggattcctcaattcttgtgccataccatggatggttagttcatcccggcttttttgtttgtcattggaagttcttttattgattcaattttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaatgtgaaagttataactattaacttttgactaaacttgaaaaaattcacatttttgatgtggaaccaaatctgatttgagaaccaagttgattttgattggattttgcaggagaatttagccacagaactcaccatcaaaatcatggacacattgagaaggatgaatcctgggttccagtatgtgattaactacttcctctatagttatttttgattcaattaaatttatttatttaataagttcaagaaaaaggaatcttatactcagataaagctgttcttgaacatttttttagtcattatcttagttaaccgag

SEQ ID NO: 2134 - DNA, 419 bp, Artificial
  Glycine max FAD3A mutation created with TALEN pair GmFAD3_T02.1
  misc_feature (251): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacaattcctcaattcttgtgccataccatggatggttagttcatcccggcttttttcgtttgtcattggaagttctttttattgnttcaatttttatagcgtgttcggaaacgcgtttcagaaaattaatgaaaatacatcttgaattctgaaaacgttataacttttagcttcattgtcattgaaagttcttttattaattatattttattgcgtgtttggaatcccatttgagaaataagaaatcacgttt

SEQ ID NO: 2135 - DNA, 734 bp, Artificial
  Glycine max FAD3A mutation created with TALEN pair GmFAD3_T02.1
  misc_feature (680): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttntacttcagataaagctgttcttgaacattttttttgtcattatctagttaaccg

SEQ ID NO: 2136 - DNA, 736 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacactgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttgtcattatctagttaaccg

SEQ ID NO: 2137 - DNA, 735 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggagcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttcgtcattatcttagttaaccg

SEQ ID NO: 2138 - DNA, 744 bp, Artificial
  Glycine max FAD3A mutation created with TALEN pair GmFAD3_T02.1
cactgctttgttatctacctcatttcatttggctttagacaacttaaatttgagatctttattatgttttttgcttatatggtaaagtgattcattcttcacattgaattgaacagtggccatggaagcttttcagacagcccttttctaaatagcctggttgcattcctcaattcttgtgccataccatggatggttagttcatcccggcttttttgtttgtcattggaagttcttttattgattcaatttttatagcgtgttaggaaacgcgtttcagaaaataatgaaatacatcttgaatctgaaagttataacttttagcttcattgtcattgaaaagttcttttattaattatatttttattgcgtgtttggaatcccatttgagaaataagaaatcacgtttaaaatgtgaaagttataactattaacttttgactaaacttgaaaaaattcacatttttgatgtggaaccaaatctgatttgagaaccaatgttgattttgattggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaggaatcttatacttcagataaagctgttcattgaacatttttttgtcattatcttagttaaccgagacaaggcatcatca

SEQ ID NO: 2139 - DNA, 713 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagccttcaattcttgtgccataccatggatggttagttcatcccggcttttttgtttgtcattggaagttcttttattgattcaatttttatagcgtgttcggaaacgcgttcagaaaataatgaaatacatcttgaatctgaaagttataacttttagcttcattgtcattgaaaagttctttttattaattatattttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattccaattaaatttatttatttaataagttcaagaaaaaagggaatctttatacttcagataaagctgttcttgaacatttttttagtcattatcttag

SEQ ID NO: 2140 - DNA, 712 bp, Artificial
  Glycine max FAD3A mutation created with TALEN pair GmFAD3_T02.1
  misc_feature (677): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacattcctcaattcttgtgccataccatggatggttagttcatcccggcttttttgtttgtcattggaagttctttttattgattcaatttttatagcgtgttcggaaacgcgtttcagaaaataatgaaaatacatctttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttataagttcaagaaaaatggaatctttntacttcagataaagctgttcttgaacatttttttt

SEQ ID NO: 2141 - DNA, 721 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaaattgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagtttcaagaaaaaagggaatctttatacttcagataaagctgttcttgaacattttttttagtcattatcttagttaaccgag

SEQ ID NO: 2142 - DNA, 734 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacactgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaagaaagatctttatacttcagataaagctgttcttgaacatttttttgtcattatctagttaaccga

SEQ ID NO: 2143 - DNA, 698 bp, Artificial
  Glycine max FAD3A mutation created with TALEN pair GmFAD3_T02.1
  misc_feature (678): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaagtcatggacacattgagaaggatgaatcctgggttccagtatgtgattaacctacttcctctatagtatttttgattcaattaatttatttatttataagttcaagaaaatggaatctttntacttcagataaagctgttc

SEQ ID NO: 2144 - DNA, 854 bp, Artificial
  Glycine max FAD3A mutation created with TALEN pair GmFAD3_T02.1
  misc_feature (369): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacattattaacaaaattctagagagattttggatgaaagattgttaaccaagtgttgctcccattgtgaaaggtgataggtttaatttgaaccaatgtccaaagaatgactttgagagggaacaaatgaaaaacattccttgcattcctcaattcttgtgccataccatggatggttagttcatcccggctttttgtttgncattggaagttcttttattgatcaatttttatagcgtgttcggaaacgcgtttcagaaataatgaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaatcttgaaaaaaactcacatttttgatgtgggaaccaaaatctgattgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaattaagttcaagaaaaatggaatctttatacttcagataaagctgttcttgaacattttttt

SEQ ID NO: 2145 - DNA, 698 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacagcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttataacttcagataaagc

SEQ ID NO: 2146 - DNA, 737 bp, Artificial; identical to SEQ ID NO: 1478
  Glycine max FAD3A mutation created with TALEN pair GmFAD3_T02.1

SEQ ID NO: 2147 - DNA, 710 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggactcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaagggaatctttatacttcagataaagctgttcttgaacattttttt

SEQ ID NO: 2148 - DNA, 736 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtggcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaaatgtgaaagttataactattaacttttgactaaacttgaaaaaattcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaagggaatctttatacttcagataaagctgttcttgaacatttttttagtcattatcttagttaaccgag

SEQ ID NO: 2149 - DNA, 611 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacagcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggatttgcaggagaattagccacagaactcaccatcaaaatcatggacacattgagaaggatgaatcctgggttccagtatgtgattaactac

SEQ ID NO: 2150 - DNA, 784 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacttgccggtgctgtgccaggcccacggcttgacccccagcaggtggtggccgtctccagcgcctgcttgccgccatcgtggctggcgatggtccagcggctgttgccggtgctgtgccaggcccacggcttgaccccggagcaggtggtggccatcgccagcaattcctcaattcttgtgccataccatggatggttagttcatcccggcttttttgtttgtcattggaagttcttttattgattcaatttttatagcgtgttcggaaacgcgttcagaaaataatgaaatacatcttgaatctgaaagttataacttttagcttcattgtcattgaaagttcttttattaattatattttattgcgtgtttggaatccatttgagaaataagaatcacgtttaaaatgtgaaagttataactattaacttttgactaaacttgaaaaatcacattttgatgtggaaccaaatctgatttgagaaccaagtttgattttgatggattttgcaggtagaattagccaacatgaacttcaccatcaaaatcatggacacattgagaaggatgaatcctgggttccaagtattgtgattaactacttcctctatagtt

SEQ ID NO: 2151 - DNA, 725 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacagcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaatgtgaaagttataactattaacttttgactaaacttgaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaacctacttcctctatagttatttttgattcaattaatttatttatttataagttcaagaaaatggaatctttatacttcagataaagctgttcttgaacattttttttcgtcattatctagt

SEQ ID NO: 2152 - DNA, 740 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacatgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttcgtcattatcttagttaaccg

SEQ ID NO: 2153 - DNA, 733 bp, Artificial
  Glycine max FAD3A mutation created with TALEN pair GmFAD3_T02.1
  misc_feature (677); (686): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgattgagaaccaagttgattttgatggattttgcaggagaattagccacagaactcaccatcaaaagtcatggacacattgagaaggatgaatcctgggttccagtatgtgattaactacttcctctatagtatttttgattcaattaaatttatttatttataagttcaagaaaaatggaatcttntacttcagntaaagctgttcttgaacattttttttcgtcattatctagttaaccga

SEQ ID NO: 2154 - DNA, 740 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacaagcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttcgtcattatcttagttaaccg

SEQ ID NO: 2155 - DNA, 731 bp, Artificial
  Glycine max FAD3A mutation created with TALEN pair GmFAD3_T02.1
  misc_feature (650); (677): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaatttatttnttataagttcaagaaaatgaatctttntacttcagataaagctgttcttgaacattttttttcgtcattatctagttaacc

SEQ ID NO: 2156 - DNA, 734 bp, Artificial
  Glycine max FAD3A mutation created with TALEN pair GmFAD3_T02.1
  misc_feature (680): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaatttatttatttaataagttcaagaaaaatggaatctttntacttcagataaagctgttcttgaacattttttttcgtcattatctagttaacc

SEQ ID NO: 2157 - DNA, 689 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggatttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcaga

SEQ ID NO: 2158 - DNA, 733 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttgtcattatctagttaacc

SEQ ID NO: 2159 - DNA, 739 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcgatggccaccacctgctccggggtcaagccgtgggcctggcacagcaccggcaacagccgctggaccgtctccagcgcctgcttgccaccattattgctggcgatggccaccttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaatcacattttgatgtggaaccaaatctgattgagaaccaagttgatttgatggattttgcaggagaattagccacagaactcaccatcaaaatcatggacacattgagaagggatgaatcctgggttccagtatgtgattactacttcctctatagttatttttggattcaatt

SEQ ID NO: 2160 - DNA, 729 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaacacatcttgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttattttatttaataagttcaagaaaaataggaaatctttatacttcagataaagctgttcttgaacattttttttgtcattatctagttaaccg

SEQ ID NO: 2161 - DNA, 745 bp, Artificial
  Glycine max FAD3A mutation created with TALEN pair GmFAD3_T02.1
  misc_feature (690): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaatgttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaaactcaccatcaaaatcatggacacattgagaaggatgaatcctgggttccagtatgtgattaactacttcctctatagttatttttgattcaattaaatttatttatttaataagttcaagaaaaatggaatctttntacttcagataaagctgttcttgaacattttttttcgtcattatctagttaaccg

SEQ ID NO: 2162 - DNA, 732 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggagcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacattttttttgtcattatcttaagttaacc

SEQ ID NO: 2163 - DNA, 739 bp, Artificial
  Glycine max FAD3A mutation created with TALEN pair GmFAD3_T02.1
  misc_feature (683): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacactgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttntacttcagataaagctgttcttgaacattttttttcgtcattatctagttaaccga

SEQ ID NO: 2164 - DNA, 726 bp, Artificial; identical to SEQ ID NO: 1628
  Glycine max FAD3A mutation created with TALEN pair GmFAD3_T02.1

SEQ ID NO: 2165 - DNA, 709 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaac

SEQ ID NO: 2166 - DNA, 607 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggatgcattcctcaattcttgtgccataccatggatggttagttcatcccggcttttttgttttgtcattggaagtttcttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaa

SEQ ID NO: 2167 - DNA, 703 bp, Artificial
  Glycine max FAD3A mutation created with TALEN pair GmFAD3_T02.1
cactgctttgttatgcctacctcatttcatttggctttagacaacttaaatttgagatctttattatgtttttgcttatatggtaaagtgattcattcttcacattgaattgaacagtggccatggaagcttttcagacagcccttttctaaatagcctggtgggcataccatggatggttagttcatcccgggcttttttgtttgtcattggaagttcttttattgattcaatttttatagcgtgttcggaaacgcgtttcagaaaataatgaaatacatcttgaatctgaaaagttataacttttagcttcattgtcattgaaaagttctttttattaattatattttattgcgtgtttggaatcccatttgagaaataagaaatcacgtttaaaaatgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttattattaataagttcaagaaaaaggaatcttatacttcagataaagctgttcttgaacatttttttagtcattatcttag

SEQ ID NO: 2168 - DNA, 735 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacacattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttcgtcattatctagttaaccg

SEQ ID NO: 2169 - DNA, 738 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacttgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttcgtcattatctaagttaaccg

SEQ ID NO: 2170 - DNA, 743 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacagcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttcgtcattatctaagttaacctgagaa

SEQ ID NO: 2171 - DNA, 749 bp, Artificial
  Glycine max FAD3A mutation created with TALEN pair GmFAD3_T02.1
  misc_feature (694): n is a or c or t or g
cactgcttttttgttgcatgaccctacctcattttcattttgggcttttagacaacttaaatttgagatctttattatgttttttgcttatatggtaaagtgattcattcttcacattgaattgaacagtggccatggaagcttttcagacagcccttttctaaatagcctggtgggacacatcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttntacttcagataaagctgttcttgaacattttttttcgtcattatctagttaaccg

SEQ ID NO: 2172 - DNA, 735 bp, Artificial
  Glycine max FAD3A mutation created with TALEN pair GmFAD3_T02.1
  misc_feature (680): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttattttatttaataagttcaagaaaaatggaatctttntacttcagataaagctgttcttgaacattttttttcgtcattatctagttaaccg

SEQ ID NO: 2173 - DNA, 735 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagtttcaagaaaaaatggaatctttatacttcagataaagctgttcttgaacattttttttcgtcattatctagttaaccg

SEQ ID NO: 2174 - DNA, 735 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggatgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattatgccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacattttttttcgtcattatcttagttaaccg

SEQ ID NO: 2175 - DNA, 809 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcgctgccgctgtctttgtaacgctcagtaatctgacgacccagttcggcgatacgcgcttttcctcaattcttgtgccataccatggatggttagttcatcccggctttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaagtgtgaaagttataactattaacttttgactaaacttgaaaaaaactcacatttttgatgtggaaccaaaattctgatttgagaaccaagttgattttgatggattttggcaggagaattagcccacagaactcaccatcaaaatcatggacacattggagaagggatgaaatcctgggttccagtatgtgatttaactacttccctctatagttattttttggattcaatttaaattttatttattaataagttcaagaaaaacggaatctttatacttcagataaagctgttcttgaaacattttttttcgtcattatcttagttaacc

SEQ ID NO: 2176 - DNA, 743 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcagcaccggcaacagccgctggaccgtctccagcgcctgcttgccaccattattgctggcgatggccaccacctgctggggggtcaagccgtgggcctggttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatattttattgcgtgtttggaatcccatttgagaaataagaaatcacgtttaaaatgtgaaagttataactattaactttgactaaacttgaaaaaatcacatttttgatgtggaaaccaaatctgatttgagaaccaagttgaattttgatggattttgcaggagaattagccacagaactcaccatcaaaatcatggacacattgagaagggatgaatcctgggttccagtatgtgattaactacttcctctatagttatttttgattcaatt

SEQ ID NO: 2177 - DNA, 660 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttcttttattaattatatttttattgcgtgtttggaatcccatttgagaaataagaaatcacgtttaaaatgtgaagttataactattaacttttgactaaacttgaaaaaatcacatttttgatgtggaaccaaatctgatttgagaaccaagttgattttgatggattttgcaggagaattagccacagaactcaccatcaaaaatcatggacacattgagaaggatgaatcctgggttccagtatgtgattaactacttcctctatagttatttttgattcaattaaatttattatttaataagttcaagaaaaaaggaatctttatacttcagataaagctg

SEQ ID NO: 2178 - DNA, 540 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttcacattgagatctttattatgttttttgtttgtcattggaagttcttttattgattcaatttttatagcgtgttcggaaacgcgtttcagaaataatgaaatacatcttgaatctgaaagttataacttttagcttcattgtcattgaaagttcttttattaattatatttttaattgcgtgtttggaatcccatttgagaaataagaaatcacgtttaaatgtgaagttataactattaactttgactaaacttgaaaaaatcacattttgatgtggaaccaaatctgatttgagaaccaagttgattttgatggattttgcaggagaattagccacagaactcatcaatcaatgagcacattgagaaggatgaatcctgggttccagtatg

SEQ ID NO: 2179 - DNA, 718 bp, Artificial
  Glycine max FAD3A mutation created with TALEN pair GmFAD3_T02.1
  misc_feature (682): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttntacttcagataaagctgttcttgaacattttttttc

SEQ ID NO: 2180 - DNA, 713 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaatgtgaaagttataactattaacttttgactaaacttgaaaaaattcacatttttgatgtggaaccaaatttgatttgagaaccaagttgattttgatggattttgcaggagaattagccacagaactcaccatcaaaatcatggacacattgagaaggtatgaatcctgggttccagtatgtgattaactacttcctctatagttattttcgattcaattaaatttatttatttaataagttcaatgaaaaaggaatctttatacttcagataaagctgttcttgaacatttttttt

SEQ ID NO: 2181 - DNA, 715 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacagcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacatttttttt

SEQ ID NO: 2182 - DNA, 738 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacactgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttcgtcattatctagttaaccg

SEQ ID NO: 2183 - DNA, 610 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacaatcgccaccaatattggtggcaagcaggcgatggccaccacctgctggggggtcaagccgtgggcctggcacagcaccggcaacagccgctggaccgtctccagcgcctgcttgccaccgccattgcattcctcaattcttgtgccataccatggatggttagttcatcccggctttttgtttgtcattggaagttcttttattgattcaatttttatagcgtgttcggaaacgcgtttcagaaataatgaaatacatcttgaatctgaaagttataacttttagcttcattgtcattgaaagttcttttattaattatattttattgcgtgttggaatcccatttgagaaataagaatcacgtttaaatgtgaaagttataactattaactttgactaaacttgaaaaaagtcacatttttgatgtggaaccaaatctga

SEQ ID NO: 2184 - DNA, 724 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacagcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacatttttttgtcattatct

SEQ ID NO: 2185 - DNA, 647 bp, Artificial
  Glycine max FAD3A mutation created with TALEN pair GmFAD3_T02.1
  misc_feature (197): n is a or c or t or g
cactgctttgttatgcctacctcatttcatttggctttagacaacttaaatttgagatctttattatgtttttgcttatatggtaaagtgattcattcttcacattgaattgaacagtggccatggaagcttttcagacagcccttttctaaatagcctggtgggacacgcattcctcaattcttgtgccataccanggatggttagttcatcccggctttttttgtttgtcattggaagttcttttattgattcaattttttatagcgtgttcggaaacgcgtttcagaaaaattaatgaaatacatcttgaatctgaaagttataacttttagcttcattgtcattgaaagttcttttataattatatttttattgcgtgtttggaatcccatttgagaaataagaaatcacgtttaaaatgtgaagttataactattaacttttgactaaacttgaaaaaactcacattttgatgtggaaccaaatctgattgagaaccaagttgattttgatggattttgcaggagaattagccacagaactcaccatcaaaatcatggacacattgagaaggatgaatcctgggttccagtatgtgattaacctacttcctctatagttatttttcgattcaattaaattta

SEQ ID NO: 2186 - DNA, 702 bp, Artificial
  Glycine max FAD3A mutation created with TALEN pair GmFAD3_T02.1
cactgctttgttatgcctacctcatttcatttggctttagacaacttaaatttgaggtctttattatgttttttgcttatatggtaaagtgattcattcttcacattgaattgaacagtggccatggaagcttttcagacagcccttttctaaatagcctggtgggagaattcctcaattcttgtgccataccatggatggttagttcatcccggcttttttgtttgtcattggaagttctttttattgattcaattttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaactttttgactaaaacttgaaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttattttatttaataagttcaagaaaaaatggaatctttatacttcagataaagc

SEQ ID NO: 2187 - DNA, 608 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaatgttataactattaacttttgactaaacttgaaaaaactcacattttgatgtggaaccaaatctgatttgagaaccaagttgattttgatggattttgcaggagaattagccacagaactcaccatcaaaagtcatggacacattgagaaggatgaatcctgggttccagtatgtgatt

SEQ ID NO: 2188 - DNA, 728 bp, Artificial
  Glycine max FAD3A mutation created with TALEN pair GmFAD3_T02.1
  misc_feature (682): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaacttcaccatcaaaatcatggacacattgagaaggatgaatcctgggttccagtatgtgattaactacttcctctatagttatttttgattcaattaaatttatttatttaataagttcaagaaaaatggaatctttntacttcagataaagctgttcttgaacattttttttcgtcattatct

SEQ ID NO: 2189 - DNA, 713 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttataagttcaagaaaaatggaatctttatacttcagataaagctgttcttgaacattttttttc

SEQ ID NO: 2190 - DNA, 717 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacaccgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacatttttttt

SEQ ID NO: 2191 - DNA, 648 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacttgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaattta

SEQ ID NO: 2192 - DNA, 717 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggatgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaactcacatttttgatgtggaaccaaatctgatttgagaaccaagttgattttgatggattttgcaggagaattatgccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacatttttttt

SEQ ID NO: 2193 - DNA, 724 bp, Artificial
  Glycine max FAD3A mutation created with TALEN pair GmFAD3_T02.1
  misc_feature (677): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggagcattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttntacttcagataaagctgttcttgaacatttttttcgtcattatctag

SEQ ID NO: 2194 - DNA, 749 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatccagcggctgttgccggtgctgtgccaggcccacggcttgaccccggagcaggtggtggccatcgccagctgggggtcaagcaggcgctggagacggtccagcggctgttgccggtgctgtgccaggcccacggcttgaccccccagcaggtggtggccatcttgcattcctcaattcttgtgccataccatggatggttagttcatcccggcttttttgtttgtcattggaagttctttattgattcaatttttatagcgtgttcggaaacgcgtttcagaaaataatgaatacatctgaatctgaaagttataacttttagcttcattgtcattgaaagtttcttttattaattatatttttattgcgtgtttggaatcccatttgagaaataagaaattcacgtttaaaatgtgaaagtttataactattaacttttgactaaacttgaaaaaaatcacatttttgatgtggaaccaaatctgatttgagaaccaagttgattttgatggatttttgcagggagaattagccacagaactcaccatcaaaatcatggacacattgagaaggatg

SEQ ID NO: 2195 - DNA, 739 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttattttatttaataagttcaagaaaaatggaatctttatacttcagataaagctgttcttgaacattttttttgtcattatctagttaaccga

SEQ ID NO: 2196 - DNA, 737 bp, Artificial; identical to SEQ ID NO: 1432
  Glycine max FAD3A mutation created with TALEN pair GmFAD3_T02.1

SEQ ID NO: 2197 - DNA, 736 bp, Artificial; identical to SEQ ID NO: 2122
  Glycine max FAD3A mutation created with TALEN pair GmFAD3_T02.1

SEQ ID NO: 2198 - DNA, 601 bp, Artificial
  Glycine max FAD3A mutation created with TALEN pair GmFAD3_T02.1
  misc_feature (170): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggactncattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacatttttgatgtggaaccaaatctgatttgagaaccaagttgattttgatggatttgcaggagaattagccacagaactcaccatcaaaagtcatggacacattgagaaggatgaatcctgggttccagtatg

SEQ ID NO: 2199 - DNA, 712 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaaatgtgaaagttataactattaacttttgactaaacttgaaaaaattcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaagggaatctttatacttcagataaagctgttcttgaacattttttt

SEQ ID NO: 2200 - DNA, 671 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggactcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaaaggaatc

SEQ ID NO: 2201 - DNA, 630 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggttcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttctttattaattatatttttattgcgtgtttggaatcccattgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaatt

SEQ ID NO: 2202 - DNA, 732 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacattttttttgtcattatcttagttaa

SEQ ID NO: 2203 - DNA, 737 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggattgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttattttatttaataagttcaagaaaaaaggaatctttatacttcagataaagctgttcttgaacattttttttgtcattatcttagttaaccg

SEQ ID NO: 2204 - DNA, 729 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggagcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacattttttttgtcattacttcttaacg

SEQ ID NO: 2205 - DNA, 750 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaagcgccgtgctgtccgtggaggagctcctgatcggcggcgagatgatcaaggccggcaccctgaccctggaggaggtgacttgcattcctcaattcttgtgccataccatggatggttagttcatcccggcttttttgtttgtcattggaagttctttttattgattcaatttttatagcgtgttcggaaaacgcgtttcagaaaaataatgaaatacatcttgaatctgaaagttataacttttagcttcattgtcattgaaagttcttttattaattatattttattgcgtgtttggaatcccatttgagaaataagaaatcacgtttaaaatgtgaaagttataactattaacttttgactaaacttgaaaaaatcacatttttgatgtggaccaaatctgatttgagaaccaagttgattttgatggattttgcaggagaatttagccacagaactcaccatcaaaatcatggacacattgagaaggatgaaatcctgggttccagtatgtgattaactacttcctctatagttatttttgattcaattaaatttatttatttaataagttcaagaaaaaggaatctttatac

SEQ ID NO: 2206 - DNA, 728 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacattcctcaattcttgtgccataccatggatggttagttcatcccggcttttttgtttgtcattggaagttctttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttgtcattatctagttaaccg

SEQ ID NO: 2207 - DNA, 717 bp, Artificial
  Glycine max FAD3A mutation created with TALEN pair GmFAD3_T02.1
  misc_feature (678): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaatttatttatttaataagttcaagaaaatggaatctttntacttcagataaagctgttcttgaacattttttttcgtc

SEQ ID NO: 2208 - DNA, 734 bp, Artificial
  Glycine max FAD3A mutation created with TALEN pair GmFAD3_T02.1
  misc_feature (679): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttataagttcaagaaaaatggaatctttntacttcagataaagctgttcttgaacattttttttcgtcattatctagttaaccg

SEQ ID NO: 2209 - DNA, 657 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacatacaatctgctctgatgccgcatagttaagccagccccgacacccgccatgcattcctcaattcttgtgccataccatggatggttagttcatcccggcttttttgtttgtcattggaagttcttttattgattcaatttttatagcgtgttcggaaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattc

SEQ ID NO: 2210 - DNA, 735 bp, Artificial
  Glycine max FAD3A mutation created with TALEN pair GmFAD3_T02.1
  misc_feature (680): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaatttatttatttataagttcaagaaaaatggaatctttntacttcagataaagctgttcttgaacattttttttcgtcattatctagttaaccg

SEQ ID NO: 2211 - DNA, 728 bp, Artificial
  Glycine max FAD3A mutation created with TALEN pair GmFAD3_T02.1
  misc_feature (682): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttntacttcagataaagctgttcttgaacattttttttcgtcattatct

SEQ ID NO: 2212 - DNA, 722 bp, Artificial
  Glycine max FAD3A mutation created with TALEN pair GmFAD3_T02.1
  misc_feature (675): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagtatttttgattcaattaatttatttattataagttcagaaaatgaatctttntacttcagataaagctgttcttgaacatttttttcgtcattatctag

SEQ ID NO: 2213 - DNA, 735 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacgcattcctcaattcttgtgccataccatggatggttagttcatcccggctttttttgttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataaagttcaagaaaaatggaatctttatacttcagataaagctgttcttgaacattttttttgtcattatctaagttaaccg

SEQ ID NO: 2214 - DNA, 726 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaaggaatctttatacttcagataaagctgttcttgaacatttttttgtcattatctt

SEQ ID NO: 2215 - DNA, 735 bp, Artificial; identical to SEQ ID NO: 1760
  Glycine max FAD3A mutation created with TALEN pair GmFAD3_T02.1

SEQ ID NO: 2216 - DNA, 730 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacatttttttgtcattatctagttaacc

SEQ ID NO: 2217 - DNA, 613 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacatattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaaatgtgaaagttataactattaacttttgactaaaacttgaaaaaaactcacatttttgatgtggaaccaaatctgatttgagaaccaagttgattttgatggattttgcaggatgaattagccacagaactcaccatcaaaatcatggacacattgagaaggatgaatcctgggttccagtatgtgattaact

SEQ ID NO: 2218 - DNA, 694 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtggcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaatttagccacagaactcaccatcaaaatcatggacacattgagaaggatgaatcctgggttccagtatgtgattaactacttcctctatagttatttttgattcaattaaatttatttatttaataagttcaagaaaaaaggaatctttatacttcagataaagctg

SEQ ID NO: 2219 - DNA, 558 bp, Artificial
  Glycine max FAD3A mutation created with TALEN pair GmFAD3_T02.1
  misc_feature (251): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggagcattcctcaattcttgtgccataccatggatggttagttcatcccggctttttttgtttgtcattggaagttctttttattgnttcaatttttatagcgtgttcggaaacgcgtttcagaaaattaatgaaaatacatcttgaatctgaaagttataacttttagcttcattgtcattgaaagttcttttattaattatatttttattgcgtgtttggaatcccatttgagaaataagaaatcacgtttaaaaatgtgaaagttataactattaacttttgactaaacttgaaaaaaactcacatttttgatgtggaaccaaatctgatttgagaaccaagttgattttgatggattttcgcaggagaattagccacagaactcaccatc

SEQ ID NO: 2220 - DNA, 732 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacactcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacattttttttgtcattatcttagttaaccg

SEQ ID NO: 2221 - DNA, 728 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttgtcattatct

SEQ ID NO: 2222 - DNA, 726 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtggcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaaaggaatctttatacttcagataaagctgttcttgaacatttttttgtcattatcttagtt

SEQ ID NO: 2223 - DNA, 654 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaagtcatggacacattgagaaggatgaatcctgggttccagtatgtgattaacctacttcctctatagttatttttcgattcaattaaatttattta

SEQ ID NO: 2224 - DNA, 733 bp, Artificial
  Glycine max FAD3A mutation created with TALEN pair GmFAD3_T02.1
cactgctttgttatgcctacctcatttcatttggcttagacaacttaaatttgagatctttattatgttttttgcttatatggtaaagtgattcattcttcacattgaattgaacagtggccatggaagcttttcagacagcccttttctaaatagcctggtgggacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttattttatttaataagttcaagaaaaaaggaatctttatacttcagataaagctgttcttgaacattttttttgtcattatcttagttaaccg

SEQ ID NO: 2225 - DNA, 703 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggagcattcctcaattcttgtgccataccatggatggttagttcatcccggcttttttgttttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaactcacatttttgatgtggaaccaaattctgatttgagaaccaagttgattttgatggattttgcaggagaattagccacagaactcaccatcaaaagtcatggacacattgagaaggatgaatcctgggttccagtatgtgattaacctacttcctctatagttattttttgattcaattaaatttattttatttataagttcaagaaaaatggaatctttatacttcagataaagctg

SEQ ID NO: 2226 - DNA, 812 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcccccggagcaggtggtggccatcgccagccacgatggcggcaagcaggcgctggagacggtccagcggctgttgccggtgctgtgccaggcccacggcttgcattcctcaattcttgtgccataccatggatggttagttcatcccggctttttgtttgtcattggaagttcttttattgattcaatttttatagcgtgttcggaaacgcgtttcagaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaactcacatttttgatgtggaaccaaatctgatttgagaaccaagttgattttgatggattttgcaggagaattagccacagaactcaccatcaaaatcatggacacattgagaagggatgaatcctgggttccagtatgtgattaactacttcctctatagttattttttggattcaattaattttattttatttaataagttcaagaaaaaggaatctttatacttcagataaagctgttcttgaaacattttttttcgtca

SEQ ID NO: 2227 - DNA, 730 bp, Artificial
  Glycine max FAD3A mutation created with TALEN pair GmFAD3_T02.1
cactgctttgttaatgcctacctcatttcatttggctttagacaacttaaatttgagatctttattatgttttttgcttatatggtaaagtgattcattcttcacattgaattgaacagtggccatggaagcttttcagacagcccttttctaaatagcctggtggggcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaaatgtgaaagttataactattaacttttgactaaacttgaaaaaatcacatttttgatgtggaaccaaatctgatttgagaaccaagttgattttgatggattttgcaggagaatttagccacagaactcaccatcaaaatcatggacacattgagaaggatgaatcctgggttccagtatgtgattaactacttcctctatagttattttgattcaattaaatttatttatttaataagttcaagaaaaaaagggaatctttatacttcagataaagctgttcttgaacatttttttagtcattatcttag

SEQ ID NO: 2228 - DNA, 742 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacagcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaatgtgaaagttataactattaacttttgactaaacttgaaaaaactcacattttgatgtggaaccaaatctgatttgagaatccaagttgattttgatggatttgcaggagaattagccacagaactcaccatcaaaagtcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttcgtcattatctagttaaccgagaa

SEQ ID NO: 2229 - DNA, 804 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatgctggcgatggccaccacctgctggggggtcaagccgtgggcctggcacagcaccggcaacagcgcctgcaccgtctccagcgcctgcttttcctcaattcttgtgccataccatggatggttagttcatcccggctttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatattttattgcgtgttggaatcccatttgagaataagaatcacgttaaatgtgaagttataactattaactttagactaaacttgaaaaagtcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaatttatttatttaatagttcaagaaaaacggaatctttatacttcagataagctgttcttgaaacatttttttcgtcattatctt

SEQ ID NO: 2230 - DNA, 735 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttaataattcagataaagctgttcttgaacattttttttgtcattatcttagttaaccg

SEQ ID NO: 2231 - DNA, 738 bp, Artificial
  Glycine max FAD3A mutation created with TALEN pair GmFAD3_T02.1
  misc_feature (682): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtggcttgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttntacttcagataaagctgttcttgaacattttttttcgtcattatcttagttaaccg

SEQ ID NO: 2232 - DNA, 735 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtggcttgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttcgtcattatctagttaaccg

SEQ ID NO: 2233 - DNA, 696 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggaattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaattcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaagggaatctttatacttcagataaagctgtt

SEQ ID NO: 2234 - DNA, 738 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacaggccaacttctcaagattgcaaaacgtggcggcgtgaccgcagtggaggcagtgcatgcatggcgcaatgcactgacgggtgccccgctcaacttgacccccagcaggtggtggccatcgccagcaataatggttgcattcctcaattcttgtgccataccatggatggttagttcatcccggctttttgtttgtcattggaagttcttttattgattcaattttatagcgtgttcggaaacgcgtttcagaaaataatgaaatacatcttgaatctgaaagttataacttttagcttcattgtcattgaaagttcttttattaattatattttattgcgtgtttggaatcccatttgagaaataagaaatcacgtttaaaatgtgaaagttataactattaactttgactaaacttgaaaaatcacatttttgatgtggaaccaaatctgatttgagaaccaagttgattttgatggattttgcaggagaattagccacagaactcaccattcaaaatcatggacacattgagaaggatgaatcctgggttccagtatgtgattaa

SEQ ID NO: 2235 - DNA, 737 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacattcctcaattcttgtgccataccatggatggttagttcatcccggcttttttgtttgtcattggaagttctttttattgattcaatttttatagcgtgttcggaaacgcgtttcagaaaataatgaaaatacaacttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttcgtcattatcttagttaaccg

SEQ ID NO: 2236 - DNA, 725 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacaccctggggtgcctaatgagtgagctaactcacattaattgcgttgcgctcactgcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacatttttttt

SEQ ID NO: 2237 - DNA, 728 bp, Artificial; identical to SEQ ID NO: 2221
  Glycine max FAD3A mutation created with TALEN pair GmFAD3_T02.1

SEQ ID NO: 2238 - DNA, 731 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacaacagccgctggaccgtctccagcgcctgcttgcattcctcaattcttgtgccataccatggatggttagttcatcccggcttttttgtttgtcattggaagttctttttattgattcaatttttatagcgtgttcggaaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagtaattagccacagaactcaccatcaaatcatggacacattgagaaggatgaatcctgggtttccagtatgtgattaactacttcctctataagttatttttgattcaattaaatttatttatttataagttcaagaaaaaagggaatctttatacttcagataaagc

SEQ ID NO: 2239 - DNA, 682 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttgtgccataccatggatggttagttcatcccggcttttttgtttgtcattgggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaaatcatggacacattgagaaggatgaatcctgggttccagtatgtgattaactacttcctctatagttattttgattcaattaaatttatttattaataagttcaagaaaaaggaatctttatacttcagataaagctgttcttgaacatttttttgtcata

SEQ ID NO: 2240 - DNA, 629 bp, Artificial
  Glycine max FAD3A mutation created with TALEN pair GmFAD3_T02.1
  misc_feature (287): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgcattcctcaattcttgtgccataccatggatggttagttcatcccggcttttttgtttgtcattggaagttcttttattgattcaatttttatagcgtgttcggaaacgcgtttcagaaaacnaatgaaatacatcttgaatctgaaaagttataacttttagcttcattgtcattgaaaagttcttttattaattatatttttattgcgtgtttggaatcccatttgagaaataagaaatcacgtttaaaatgtgaaagttataactattaacttttgactaaacttgaaaaaattcacatttttgatgtggaaccaaatctgatttgagaaccaagttgatttttgatgggattttgcaggagaattagccacagaactcaccatcaaaattcatggacacattgagaaggatgaatcctgggttccagtatgtgattaactacttcctctatagttattttt

SEQ ID NO: 2241 - DNA, 703 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttcgattcaattaaatttatttatttaataagttcaagaaaaatggaatctttatacttcagataaagctgttc

SEQ ID NO: 2242 - DNA, 734 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacaattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaaggaatctttatacttcagataaagctgttcttgaacattttttttcgtcattatcttagttaacc

SEQ ID NO: 2243 - DNA, 678 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacggtcctgggtgctggagacggcttgccaccaatattgctggcgatggccaccacctgctccggggtcaagccgtgggcctggcacagcaccggcaacagccgctggaccgtctccagcgcctgcttgccaccaatattgctggcgatggccaccacctgctccggggtcaagccgtgggccttgcattcctcaattcttgtgccataccatggatggttagttcatcccggctttttgtttgtcattggaagttcttttattgattcaatttttatagcgtgttcggaaacgcgttcagaaaataatgaaatacatcttgaatctgaaagttataacttttagcttcattgtcattgaaagttctttattaattatatttttattgcgtgtttggaatcccatttgagaaataagaaatcacgtttaaaatgtgaaagttataactattaacttttgactaaacttgaaaaatcacattttgatgtggaaccaaatctgatttgagaacc

SEQ ID NO: 2244 - DNA, 584 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacatttttgatgtggaaccaaatctgatttgagaaccaagttgattttgatggattttgcaggagaatttagccacagaactcaccatcaaaatcatggacacattgagaaggatgaatcctgggttccagtatgtgattaactacttcctctatagttatttttgattcaattaaatttatttatttaataagttcaagaaaaaacggaatctttatacttcagataaagctgttcttgaacatttttttgtcattatcttagttaaccgag

SEQ ID NO: 2245 - DNA, 794 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacaggcgctggagacggtccagcggctgttgccggtgctgtgccaggcccacgcattcctcaattcttgtgccataccatggatggttagttcatcccggcttttttgtttgtcattggaagttcttttattgattcaatttttaatagcgtgttcggaaaacgcgtttcagaaaaataatgaaatacatcttgaatctgaaagttataacttttagcttcattgtcattgaaagttcttttattaattatatttttattgcgtgtttggaatcccatttgagaaataagaaatcacgtttaaaatgtgaaaagttataactattaacttttgactaaacttgaaaaaattcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaacggaatctttcatacttcagataaaggctgtttcttgaacatttttttcgtcattatcttagtaaccgag

SEQ ID NO: 2246 - DNA, 720 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggttcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaaggaatctttatacttcagataaagctgttcttgaacatttttttgtcattatcttag

SEQ ID NO: 2247 - DNA, 647 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatggagacggtccagcggctgttgccggtgctgtgccaggcccacggcttgaccccccagcaggtggtggccatcgccagcaataatggtggcaagcaggcgctggagagcattcctcaattcttgtgccataccatggatggttagttcatcccggctttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatattttattgcgtgtttggaatcccatttgagaaataagaaatcacgtttaaaatgtgaaagttataactattaactttgactaaacttgaaaaaatcacattttgatgtggaaccaaatctgatttgagaaccaagttgattttgatggattttgcaggagaattagccacag

SEQ ID NO: 2248 - DNA, 708 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggactcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaataagaaatcacgtttaaaatgtgaaagttataactattaacttttgactaaacttgaaaaaattcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaagggaatcttatacttcagataaagctgttcttgaacattttttt

SEQ ID NO: 2249 - DNA, 759 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcgccagcaatggcggtggcaagcaggcgctggagacggtccagcggctgttgccggtgccataccatggatggttagttcatcccggcttttttgtttgtcattggaagttcttttattgattcaatttttatagcgtgttcggaaaacgcgtttcagaaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttataagttcaagaaaaaagggaatctttatacttcagataaagctgttcttgaacatttttttt

SEQ ID NO: 2250 - DNA, 639 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacagcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaatt

SEQ ID NO: 2251 - DNA, 738 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttattttatttaataagtttcaagaaaaaggaatctttatacttcagataaagctgttcttgaacattttttttcgtcattatcttagttaaccg

SEQ ID NO: 2252 - DNA, 738 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacagcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttattttatttaataagttcaagaaaaatggaatctttatacttcagataaagctgttcttgaacattttttttcgtcattatctagttaaccg

SEQ ID NO: 2253 - DNA, 617 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttgggaatcccatttgagaaataagaaatcacgtttaaaaattgtgaaagttataactattaacttttgactaaacttgaaaaaactcacatttttggatgtggaaccaaatctgatttgagaaccaagttgattttgatggattttgcaggagaattagccacagaactcaccatcaaaagtcatggacacattgagaaggatggaatcctgggttccagtatgtgattaactacttcctctatagttattttt

SEQ ID NO: 2254 - DNA, 737 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggactcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaaatgtgaaagttataactattaacttttgactaaacttgaaaaaattcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaagggaatctttatacttcagataaagctgttcttgaacattttttttagtcattatcttagttaaccgag

SEQ ID NO: 2255 - DNA, 448 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaaatcatttatgttttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaa

SEQ ID NO: 2256 - DNA, 737 bp, Artificial; identical to SEQ ID NO: 1984
  Glycine max FAD3A mutation created with TALEN pair GmFAD3_T02.1

SEQ ID NO: 2257 - DNA, 415 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagccccttttctaaatagcctggtgggacacaattcctcaattcttgtgccataccatggatggttagttcatcccggcttttttgttttgtcattggaagttctttttattgaatcaatttttatagcgtgtttcggaaacgcgtttcagaaaataatgaaaatacatcttgaatctgaaagttataacttttagcttcattgtcattgaaagttcttttataattatatttttatgcgtgtttggaatcccatttgagaaataagaaatcacg

SEQ ID NO: 2258 - DNA, 733 bp, Artificial
  Glycine max FAD3A mutation created with TALEN pair GmFAD3_T02.1
  misc_feature (679): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttattttatttaataagttcaagaaaaatggaatctttntacttcagataaagctgttcttgaacattttttttgtcattatctagttaaccg

SEQ ID NO: 2259 - DNA, 730 bp, Artificial
  Glycine max FAD3A mutation created with TALEN pair GmFAD3_T02.1
  misc_feature (475): n is a or c or t or g
cactgctttgttaatgcctacctcatttcatttggctttagacaacttaaatttgagatctttattatgttttttgcttatatggtaaagtgattcattcttcacattgaattgaacagtggccatggaagcttttcagacagcccttttctaaatagcctggtggggcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaaatgtgaaagttataactattaacttttgactaaactgaaaaaattcacatttttgntgtggaaccaaatctgattgagaaccaagttgattttgatggattttgcaggagaattagccacagaactcaccatcaaaattcatggacacattgagaaggatgaatcctgggttccagtatgtgattaactacttcctctatagttatttttcgattcaattaaatttatttatttaataagttcaagaaaaaagggaatctttatacttcagataaagctgttcttgaacatttttttagtcattatcttag

SEQ ID NO: 2260 - DNA, 726 bp, Artificial
  Glycine max FAD3A mutation created with TALEN pair GmFAD3_T02.1
  misc_feature (647): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgttcaattaatttatttntttaataagtttcaagaaaaatggaatctttatacttcagataaagctgttcttgaacattttttttgtcattatctag

SEQ ID NO: 2261 - DNA, 726 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggtcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaatagaatcacgtttaaatgtgaagttataactattaacttttgactaaacttgaaaaaattcacatttttgatgtggaaccaaatctgatttgagaaccaagttgattttgatggattttgcaggagaattagccacagaactcaccatcaaatcatggacacattgagaaggatgaatcctgggttccagtatgtgattaactacttcctctatagttatttttcgattcaattaatttatttatttaataagttcaagaaaaagggaatctttatacttcagataaagctgttcttgaacatttttttagtcattatcttagttaaccgag

SEQ ID NO: 2262 - DNA, 737 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacactgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacattttttttcgtcattatcttagttaaccg

SEQ ID NO: 2263 - DNA, 726 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagtttcaagaaaaaggaatctttatacttcagataaagctgttcttgaacattttttttgtcattatctt

SEQ ID NO: 2264 - DNA, 731 bp, Artificial
  Glycine max FAD3A mutation created with TALEN pair GmFAD3_T02.1
  misc_feature (677): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttntacttcagataaagctgttcttgaacattttttttgtcattatctagttaaccg

SEQ ID NO: 2265 - DNA, 735 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggagcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttataagttcaagaaaaatggaatctttatacttcagataaagctgttcttgaacattttttttcgtcattatctagttaacc

SEQ ID NO: 2266 - DNA, 721 bp, Artificial
  Glycine max FAD3A mutation created with TALEN pair GmFAD3_T02.1
  misc_feature (681): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttntacttcagataaagctgttcttgaacattttttttcgtca

SEQ ID NO: 2267 - DNA, 654 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatccagcggctgttgccggtgctgtgccaggcccacggcttgaccccggagcaggtggtggccatcgccagcaatattggtggcaagcaggcgctggagacggtgcaggcgctgttgccttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatattttattgcgtgtttggtaatcccatttgagaaattaagaaatcacgtttaaaatgtgaaagtataactattaactttgactaaaacttgaaaaaaatcactatttttgatgtgggaaccaaaattcgaatttgagaaccaagttgattttgatggattttgcagg

SEQ ID NO: 2268 - DNA, 739 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttcgtcattatctagttaaccg

SEQ ID NO: 2269 - DNA, 738 bp, Artificial
  Glycine max FAD3A mutation created with TALEN pair GmFAD3_T02.1
  misc_feature (250); (682): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacgcattcctcaattcttgtgccataccatggatggttagttcatcccggcttttttgtttgtcattggaagttcttttattgnttcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttntacttcagataaagctgttcttgaacattttttttcgtcattatctagttaaccga

SEQ ID NO: 2270 - DNA, 729 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacagcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagtcttcattgtcattgaaagttacttttatttaattattatttttatttgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttattttatttaataagttcaagaaaaatggaatctttatacttcagataaagctgttcttgaacattttttttcgtcattatc

SEQ ID NO: 2271 - DNA, 742 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacactgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttgtcattatctagttaaccgagaagc

SEQ ID NO: 2272 - DNA, 515 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacaattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgacttttg

SEQ ID NO: 2273 - DNA, 715 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaaatgtgaaagttataactattaacttttgactaaacttgaaaaaattcacatttttgatgtggaaccaaatctgatttgagaaccaagttgattttgatggaattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaaggaatctttatacttcagataaagctgttcttgaacatttttttt

SEQ ID NO: 2274 - DNA, 734 bp, Artificial
  Glycine max FAD3A mutation created with TALEN pair GmFAD3_T02.1
  misc_feature (679): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacatgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaatttatttatttataagttcaagaaaaatggaatctttntacttcagataaagctgttcttgaacattttttttcgtcattatctagttaaccg

SEQ ID NO: 2275 - DNA, 723 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatattttattgcgtgtttggaatcccatttgagaaataagaaatcacgtttaaaaattgtgaaagttataactattaacttttgactaaacttgaaaaaactcacatttttgatgtggaaccaaatctgatttgagaaccaagttgatttgatggattttgcagagaattagccacagaactcaccatcaaaatcatggacacattgagaaggatgaatcctgggttccagtatgtgattaactacttcctctatagttatttttggattccaattaaatttatttatttaataagttcaagaaaaaagggaatcttatacttcagataaagctgttcttgaacatttttttagtcattatcttagttaaccgag

SEQ ID NO: 2276 - DNA, 450 bp, Artificial
  Glycine max FAD3A mutation created with TALEN pair GmFAD3_T02.1
  misc_feature (277); (288); (383): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcccttttcctcaattcttgtgccataccatggatggttagttcatcccggcttttttgtttgtcattggaagttcttttattgattcaattttatagcggtcggaaacgctttcgaaaanaatgaaatacncttgaatctgaaagttatacttttagcttcttgtcattgaaagttctttttatttaaattatatttttatttgcgtgtttggaaatcccatttgngaaataagaaatcacgttaaaaatgtgaaagttataactattaactttttgactaaacttgaaaaaa

SEQ ID NO: 2277 - DNA, 695 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaaatgtgaaagttataactattaacttttgactaaacttgaaaaaattcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaagggaatctttatacttcagataaagctg

SEQ ID NO: 2278 - DNA, 550 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaacatcctcaattcttgtgccataccatggatggttagttcatcccggcttttttgtttgtcattggaagttcttttattgattcaattttatagcgtgttcggaaacgcgtttcagaaaataatgaaatacatcttgaatctgaaagttataacttttagcttcatttgtcattgaaagttcttttattaattatattttattgcgtgtttggaatcccatttgagaaataagaaatcacgtttaaaattgtgaaagttataactattaacttttagactaaatcttgaaaaaactcacattttgatgtggaccaaatctgatttgagaaccaagttgatttgatggattttgcaggagaattagccacagaactcaccatcaaaagtcatggacac

SEQ ID NO: 2279 - DNA, 758 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaaatcacgtttaaaaatgtgaaagttataactattaacttttgactaaaacttgaaaaaaatcacattttgatgtggaaccaaatctgatttgagaaccaagttgattttgatggattttgcaggagaattagccacagaactcaccatcaaaatcatggacacattgagaaggatgaaatcctgggttccagtatgtgattaactaacttctctatagttatttttgatttcaattaaatttaattttattttaaattaaagtttcaaagaaaaaataggaaaagatctttataacttcagataaaagctgttctttgaacattttttttgtcattatctagttaaccg

SEQ ID NO: 2280 - DNA, 556 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcgctggagacggtccagcggctgttgccggtgctgtgccaggcccacggcttgaccccggagcaggtggtggccatcgccagccacgatggcggcaacagccgctggaccattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttattaattatattttattgcgtgtttggaatcccatttgagaaataagaaatcacgttaaaatgtgaaagttataactattaacttttgact

SEQ ID NO: 2281 - DNA, 736 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggaccattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttattttatttaataagtttcaagaaaaaaggaatctttatacttcagataaagctgttcttgaacattttttttgtcattatcttagttaaccg

SEQ ID NO: 2282 - DNA, 733 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaatgtgaaagttataactattaacttttgactaaacttgaaaaaattcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaagggaatctttatacttcagataaagctgttcttgaacatttttttagtcattatcttagttaaccgag

SEQ ID NO: 2283 - DNA, 740 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaaacttgaaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaacctacttcctctatagttatttttgattcaattaaatttattttatttaataagttcaagaaaaatggaatctttatacttcagataaagctgttcttgaacattttttttcgtcattatctagttaacc

SEQ ID NO: 2284 - DNA, 726 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagtttcaagaaaaaggaatctttatacttcagataaagctgttcttgaacatttttttgtcattatctt

SEQ ID NO: 2285 - DNA, 737 bp, Artificial
  Glycine max FAD3A mutation created with TALEN pair GmFAD3_T02.1
  misc_feature (681): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaatttatttatttaataagttcaagaaaaatggaatctttntacttcagataaagctgttcttgaacattttttttcgtcattatctagttaaccga

SEQ ID NO: 2286 - DNA, 738 bp, Artificial
  Glycine max FAD3A mutation created with TALEN pair GmFAD3_T02.1
  misc_feature (684): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacatgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttattttatttaataagttcaagaaaaatggaatctttntacttcagataaagctgttcttgaacattttttttcgtcattatctagttaacc

SEQ ID NO: 2287 - DNA, 735 bp, Artificial
  Glycine max FAD3A mutation created with TALEN pair GmFAD3_T02.1
  misc_feature (682): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacagcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttataagttcaagaaaaatggaatctttntacttcagataaagctgttcttgaacatttttttgtcattatctagttaaccg

SEQ ID NO: 2288 - DNA, 715 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacttgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttt

SEQ ID NO: 2289 - DNA, 716 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacttgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttattttatttaataagttcaagaaaaaggaatctttatacttcagataaagctgttcttgaacatttttttt

SEQ ID NO: 2290 - DNA, 823 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatccagcggctgttgccggtgctgtgccaggcccacggcttgaccccggagcaggtggtggccatcgccagcaatattggtggcaagcaggcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaatcacattttgatgtggaaccaaatctgatttgagaacaagttgatttgatggattttgcaggagaattagccacagaactcaccatcaaaatcatggacacattgagaagggatgaatcctgggttccagtatgtgattaactacttcctctatagttattttttggattcaattaattttattttatttaataagttcaagaaaaaggaatctttatacttcagataaagctgttcttgaaacatttttttcgtcattatctttagtt

SEQ ID NO: 2291 - DNA, 734 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacagcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggatttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatactcagataaagctgttcttgaacatttttttgtcattatctaagttaaccg

SEQ ID NO: 2292 - DNA, 736 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttattttatttaataagttcaagaaaaatggaatctttatacttcagataaagctgttcttgaacatttttttcgtcattatctagttaaccg

SEQ ID NO: 2293 - DNA, 739 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacagcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttcgtcattatctagttaaccga

SEQ ID NO: 2294 - DNA, 620 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggactcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaatgtgaaagttataactattaacttttgactaaacttgaaaaaattcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagtta

SEQ ID NO: 2295 - DNA, 734 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaatgtgaaagttataactattaacttttgactaaacttgaaaaaattcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaagggaatctttatacttcagataaagctgttcttgaacatttttttagtcattatcttagttaaccgag

SEQ ID NO: 2296 - DNA, 733 bp, Artificial
  Glycine max FAD3A mutation created with TALEN pair GmFAD3_T02.1
  misc_feature (527): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggatgcattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggngaattagccacagaactcaccatcaaaatcatggacacattgagaaggatgaatcctgggttccagtatgtgattaactacttcctctatagttatttttgattcaattaaatttatttatttataagttcaagaaaaaggaagtctttatacttcagataaagctgttcttgaacattttttttcgtcattatcttagttaaccg

SEQ ID NO: 2297 - DNA, 717 bp, Artificial
  Glycine max FAD3A mutation created with TALEN pair GmFAD3_T02.1
  misc_feature (681): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttataagttcaagaaaaatggaatctttntacttcagataaagctgttcttgaacattttttttc

SEQ ID NO: 2298 - DNA, 618 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggattgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaaataagaaatcacgtttaaaattgtgaaagttataactattaacttttgactaaacttgaaaaaactcacatttttgatgtggaaccaaatctgatttgagaaccaagttgatttgatggattttgcaggagaattagccacagaactcaccatcaaaatcatggacacattgagaaggatgaatcctgggttccagtatgtgattaactacttcctctatagttatttttgatt

SEQ ID NO: 2299 - DNA, 715 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacatgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacatttttttt

SEQ ID NO: 2300 - DNA, 676 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggatttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaat

SEQ ID NO: 2301 - DNA, 726 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggaccctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaatgtgaaagttataactattaacttttgactaaacttgaaaaaattcacatttttgatgtggaaccaaatctgatttgagaaccaagttgattttgatggattttgcaggagaatttagccacagaactcaccatcaaaatcatggacacattgagaaggatgaatcctgggttccagtatgtgattaactacttcctctatagttatttttgattcaattaaatttatttatttaataagttcaagaaaaaagggaatctttatacttcagataaagctgttcttgaacatttttttagtcattatcttag

SEQ ID NO: 2302 - DNA, 692 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtggggcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaaggaatctttatacttcagataaagc

SEQ ID NO: 2303 - DNA, 736 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtggggcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaatgtgaaagttataactattaacttttgactaaacttgaaaaaattcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaaggaatctttatacttcagataaagctgttcttgaacatttttttagtcattatcttagttaaccgag

SEQ ID NO: 2304 - DNA, 674 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaaagttataactattaacttttgactaaacttgaaaaaatcacatttttgatgtggaaccaaatctgattgagaaccaagttgattttgatggattttgcaggagaattagccacatgaactcaccatcaaaatcatggacacattgagaaggatgaatcctgggttccagtatgtgattaactacttcctctatagttatttttgattcaattaaatttatttatttaataagttcaagaaaaaaatggaatctttatacttcagataaaagctagttcttgaacaatttttttttgtcattatctagtttaaccgagaag

SEQ ID NO: 2305 - DNA, 658 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataag

SEQ ID NO: 2306 - DNA, 427 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagctgttgccggtgcttgacatagcattggatcggatcccaggcccacggcttgacccggctttttgtttgtcattggaagttcttttattgattcaatttttatagcgtgttcggaaaccgcgtttcagaaaataatgaaatacatcttgaatctgaaagttataacttttagcttcattgtcattgaaaagttctttttattaaattatattttcattgcgtgtttggaaatcccatttgagaaattaagaaatcacgtttaaaaattgtgaaagttataactattaacttttgact

SEQ ID NO: 2307 - DNA, 591 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacataggtgcctgcttgccaccaatattgctggcgatggccaccacctgctccggggtcaagccgtgggcctggcacagcaccggcaacagccgctggaccgtcttgcattcctcaattcttgtgccataccatggatggttagttcatcccggctttttggtttgtcattggaagttcttttattgattcaatttttatagcgtgttcggaaacgcgtttcagaaataatgaaatacatcttgaatctgaaagttataactttagcttcattgtcattgaaagttcttttattaattatattttattgcgtgtttggaatccccatttgagaaataagaatcacgtttaaatgtgaaagttataactattactttgactaaacttgaaaaaagtcacatttttgatgtggaaccaaatctga

SEQ ID NO: 2308 - DNA, 729 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctgatggccctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaataagaatcacgtttaaaatgtgaagttataactattaacttttgactaaacttgaaaaaattcacatttttgatgttggaaccaaatctgatttgagaaccaagttgattttgatggattttgcaggagaatttagccacagaactcaccatcaaaatcatggacacattgagaaggatgaatcctgggttccagtatgtgattaactacttcctctatagttatttttgattcaattaaatttatttatttaataagttcaagaaaaagggaatctttatacttcagataaagctgttcttgaacatttttttagtcattatcttagttaaccga

SEQ ID NO: 2309 - DNA, 736 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacagcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacatttttttcgtcattatctagttaaccga

SEQ ID NO: 2310 - DNA, 826 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacattgctggcgatggccaccacctgctccggggtcaagccgtgggcctggcacagcaccggcaacagcgcctgcaccgtctcttgcattcctcaattcttgtgccataccatggatggttagttcatcccggcttttttgtttgtcattggaagttctttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaactcacatttttgatgtggaaccaaattctgatttgagaaccaagttgattttgatggattttggctaggagaattagcccacagaactcaccatcaaaatcatggacacattgagaagggatgaaatcctgggttccagtatgtgatttaactacttcctctatagttattttttgattcaattaattttatttattaataagttcaagaaaaaggaatctttatacttcagataaagctgttcttgaaacattttttttcgtcattatcttagttaacc

SEQ ID NO: 2311 - DNA, 736 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacatgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttcgtcattatctagttaaccg

SEQ ID NO: 2312 - DNA, 735 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacattttttttcgtcattatcttagttaaccg

SEQ ID NO: 2313 - DNA, 738 bp, Artificial
  Glycine max FAD3A mutation created with TALEN pair GmFAD3_T02.1
  misc_feature (683): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacactgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttntacttcagataaagctgttcttgaacattttttttcgtcattatctagttaaccg

SEQ ID NO: 2314 - DNA, 523 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacttgctggcgatggccaccacctgctggggggtcaagccgtgggcctggcacagcaccggcaacagccgctggaccgtctccagcgcctgcttgccacctgccattgctggcgatggcccaccatcctgctggggggtcaatgccgtgggcctggcacagcaccggcaacagccgctggaccgtctccatggatggttagttcatcccggctttttgtttgtcattggagttcttttattgattcaattttatagcgtgttcggaaacgcgtttcagaaaataatgaaatacatcttgatctgaaagttataacttttagcttcattgtcattgaaagttcttttattaattat

SEQ ID NO: 2315 - DNA, 742 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacactgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttcgtcattatctagttaaccgagaa

SEQ ID NO: 2316 - DNA, 741 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacctccagcgcctgcttgccaccaatattgctggcgatggccaccacctgctccggggtcaagccgtgggcctggcacagcaccggcaacagccgctggaccatcttgcattcctcaattcttgtgccataccatggatggttagttcatcccggctttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatattttattgcgtgtttggaatccccatttgagaaataagaaatcacgtttaaaatgtgaaagttataactattaactttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaatt

SEQ ID NO: 2317 - DNA, 612 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaaatcatttatgttttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaaatcacgtttaaaaatgtgaaaagttataaactattaacttttgactaaaacttgaaaaaatcacatttttgatgtggaaccaaaatctgatttgagaaccaagttgattttgatggattttgcaggagaattagccacagaactcaccatcaaaatcatggacacattgagaaggatgaaatcctgggttccagtatgtgattaactacttcctctatagttattttgattcaattaaatttatttatttaataagttcaagaaaaaaggaatctttatacttcagat

SEQ ID NO: 2318 - DNA, 702 bp, Artificial
  Glycine max FAD3A mutation created with TALEN pair GmFAD3_T02.1
  misc_feature (675): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagtatttttgattcaattaatttatttatttataagttcaagaaaaatggaatctttntacttcagataaagctgttcttgaaca

SEQ ID NO: 2319 - DNA, 451 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtggtggccatcgccagcaatggcggtggcaagcaggcgctggagacggtccagcggctgttgccggtgctggcgatggccaccacctgctccggggtcaagccgtgggccatcattcctcaattcttgtgccataccatggatggttagttcatcccggctttttggtttgtcattggaagttcttttattgattcaatttttatagcgtgtttcggaaacgcgtttcagaaaagtaatgaaatacatcttgaatctgaaagttataacttttagcttcattgtcattg

SEQ ID NO: 2320 - DNA, 739 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaatggaatctttatacttcagataaagctgttcttgaacattttttttcgtcattatctagttaaccg

SEQ ID NO: 2321 - DNA, 736 bp, Artificial
  Glycine max FAD3A mutation created with TALEN pair GmFAD3_T02.1
  misc_feature (681): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacaacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttntacttcagataaagctgttcttgaacattttttttcgtcattatctagttaaccg

SEQ ID NO: 2322 - DNA, 714 bp, Artificial
  Glycine max FAD3A mutation created with TALEN pair GmFAD3_T02.1
cactgctttgttatgcctacctcatttcatttggctttagacaacttaaatttgagatctttattatgttttttgcatatatggtaaagtgattcattcttcacattgaattgaacagtggccatggaagcttttcagacagcccttttctaaatagcctggtggggtgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaaggaatctttatacttcagataaagctgttcttgaacatttttttt

SEQ ID NO: 2323 - DNA, 676 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcattcctcaattcttgtgccataccatggatggttagttcatcccggcttttttgtttgtcattgggaagttcttttattgattcaatttttatagcgtgttcggaaacgcgtttcagaaaataatgaaatacatcttgaatctgaaagttataacttttagcttcattgtcattgaaaagttcttttattaattatatttttaattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaaatcatggacacattgagaaggatgaatcctgggttccagtatgtgattaactacttcctctatagttatttttgattcaattaaatttatttatttaataagttcaagaaaaaagaatctttatacttcagataaagctgttcttgaacatttttttt

SEQ ID NO: 2324 - DNA, 620 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaatggcattcctcaatttcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatattttattgcgtgtttggaatcccatttgagaaataagaaatcacgtttaaaatgtgaaagttataactattaacttttgactaaacttgaaaaaatcacatttttgatgtggaaccaaatctgattttgagaaccaagttgaattttgatggattttgcaggagaattagccacagaactcaccatcaaaatcatggacacattgagaaggatgaatcctgggttccagtatgtgattaactacttcctctatagttatttttga

SEQ ID NO: 2325 - DNA, 651 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacacatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatattttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttattattaataagttcaagaaaaaaggaatc

SEQ ID NO: 2326 - DNA, 737 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtggcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaatgtgaaagttataactattaacttttgactaaacttgaaaaaattcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaagggaatctttatacttcagataaatgctgttcttgaacattttttttagtcattatcttagttaaccgag

SEQ ID NO: 2327 - DNA, 737 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaatgtgaaagttataactattaacttttgactaaacttgaaaaaattcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaagggaatctttatacttcagataaagctgttcttgaacattttttttagtcattatcttagttaaccgag

SEQ ID NO: 2328 - DNA, 696 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgttttggaatcccatttgagaaataagaaatcacgtttaaaaatgtgaaagttataactattaacttttgactaaacttgaaaaaatcacatttttgatgtggaaccaaatctgatttgagaaccaagttgatttttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaagggaatctttatacttcagataaagctg

SEQ ID NO: 2329 - DNA, 722 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacatgcattcctcaattcttgtgccataccatggatggttagttcatcccggcttttttgttttgtcattggaagttctttttatgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttttgattcaattaaatttattttatttaataagttcaagaaaaaggaatctttatacttcagataaagctgttcttgaacattttttttcgtca

SEQ ID NO: 2330 - DNA, 607 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcatgtcttcacattgaattgaacagtggccatggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacatttttttt

SEQ ID NO: 2331 - DNA, 689 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggtcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaccaagttgattttgatggattttgcaggagaattagccacagaactcaccatcaaaatcatggacacattgagaaggatgaatcctgggttccagtatgtgattaactacttcctctatagttattttgattcaattaaatttattattaataagttcaagaaaaaaggaatcttatacttcagataaagctgatt

SEQ ID NO: 2332 - DNA, 725 bp, Artificial
  Glycine max FAD3A mutation created with TALEN pair GmFAD3_T02.1
  misc_feature (681): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacactcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttntacttcagataaagctgttcttgaacattttttttgtcattatc

SEQ ID NO: 2333 - DNA, 637 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacgcattcctcaattcttgtgccataccatggatggttagttcatcccggcttttttgtttgtcattggaagttctttttattgattcaatttttatagcgtgttcggaaacgcgtttcaggaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaactcacattttgatgtggaaccaaatctgatttgagaaccaagttgattttgatggattttgcaggagaattagccacagaactcaccatcaaaatcatggacacattgagaaaggatgaatcctgggttccagtatgtgattaactacttccctatagtatttttgattcaa

SEQ ID NO: 2334 - DNA, 826 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcagcaccggcaacagccgctggaccgtctccagcgcctgcttgccaccattattgctggcgatggccaccacctgctggggggtcaagccgtgggcctggttgcattcctcaattcttgtgccataccatggatggttagttcatcccggctttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatattttattgcgtgttggaatcccatttgagaaataagaatcacgtttaaaatgtgaaagttataactattaacttttgactaaacttgaaaaaagtcacatttttgatgtggaaaccaaatctgatttgagaaccaagttgattttgatggattttgcaggagaattagccacagaactcaccatcaaaatcatggacacattgagaaggatgaatcctgggttccagtatgtgattaactacttcctctatagttatttttggattcaattaatttatttatttatagttcaagaaaaacggaatctttatacttcagataaagctgttcttgaaacattttttttcgtcattatc

SEQ ID NO: 2335 - DNA, 737 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacactgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacatttttttgtcattatctagttaaccga

SEQ ID NO: 2336 - DNA, 726 bp, Artificial
  Glycine max FAD3A mutation created with TALEN pair GmFAD3_T02.1
  misc_feature (680): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacagcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttntacttcagataaagctgttcttgaacattttttttcgtcattatct

SEQ ID NO: 2337 - DNA, 650 bp, Artificial
  Glycine max FAD3A mutation created with TALEN pair GmFAD3_T02.1
cactgctttgttatgctacctcatttcatttggctttagacaacttaaatttgagatctttattatgttttttgcttatatggtaaagtgattcattcttcacattgaattgaacagtggccatggaagcttttcagacagcccttttctaaatagcctggtgggacgatggttagttcatcccggcttttttgtttgtcattggaagttcttttattgattcaatttttatagcgtgttcggaaacgcgtttcagaaaataatgaaatacatcttgaatctgaaagttataacttttagcttcatttgtcattgaaagttcttttattaattatattttattgcgtgtttggaatcccatttgagaaattaagaaatcacgttttaaaaatgtgaaagttataactattaacttttgactaaaacttgaaaaaatcacattttgatgtggaaccaaatctgatttgagaaccaagttgaattttgatggattttgcatggagaattagccacagaactcaccatcaaaatcatggacacattgagaaggatgaatcctgggttccagtatgtgattaactacttcctctatagttatttttgattcaattaaatttatttatttaataagttcaagaaaaaaaggaatc

SEQ ID NO: 2338 - DNA, 733 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttataagttcaagaaaaatggaatctttatacttcagataaagctgttcttgaacattttttttcgtcattatctagttaacc

SEQ ID NO: 2339 - DNA, 696 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggaattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgtttaaaaaatcacatttttgatgtggaaccaaatctgaattgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaaaggaatctttatacttcagataaagctg

SEQ ID NO: 2340 - DNA, 624 bp, Artificial
  Glycine max FAD3A mutation created with TALEN pair GmFAD3_T02.1
  misc_feature (474): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataactttttagcttcattgtcattgaaaagttcttttattaattatatttttattgcgtgtttggaatcccatttgagaaataagaaatcacgtttaaaatgtgaaagttataactattaacttttgactaaacttgaaaaaattcacatttttgntgtggaaccaaatctgatttgagaacccaagttgattttgatggattttgcaggagaattagccacagaactcaccatcaaaatcatggacacattgagaaggatgaatcctgggttccagtatgtgattaactacttcctctatagtta

SEQ ID NO: 2341 - DNA, 736 bp, Artificial; identical to SEQ ID NO: 2136
  Glycine max FAD3A mutation created with TALEN pair GmFAD3_T02.1

SEQ ID NO: 2342 - DNA, 604 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgattgagaaccaagttgattttgatggattttgcaggagaattagccacagaactcaccatcaaaagtcatggacacattgagaaggatgaatcctgggttccagtatgtgattaa

SEQ ID NO: 2343 - DNA, 736 bp, Artificial
  Glycine max FAD3A mutation created with TALEN pair GmFAD3_T02.1
  misc_feature (681): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacttgcattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttattttatttaataagttcaagaaaaatggaatctttntacttcagataaagctgttcttgaacattttttttcgtcattatctagttaaccg

SEQ ID NO: 2344 - DNA, 638 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagccccttttctaaatagcctggtggggacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaatt

SEQ ID NO: 2345 - DNA, 561 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggattgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaactcacatttttgatgtggaaccaaaatctgatttgagaaccaagttgattttgatggattttgcaggagaattagccacagaactcaccatcaaaa

SEQ ID NO: 2346 - DNA, 732 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacttcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagtatttttgattcaattaaatttatttatttataagttcaagaaaaatggaatctttatacttcagataaagctgttcttgaacattttttttcgtcattatctagttaaccg

SEQ ID NO: 2347 - DNA, 735 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacatgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacatttttttcgtcattatctagttaacc

SEQ ID NO: 2348 - DNA, 732 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagccctttagacaacttatatttgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttattttatttaataagttcaagaaaaatggaatctttatacttcagataaagctgttcttgaacattttttttcgtcattatctagttaaccga

SEQ ID NO: 2349 - DNA, 740 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacagcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttgtcattatctagttaaccgagaa

SEQ ID NO: 2350 - DNA, 718 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacagcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacatttttttt

SEQ ID NO: 2351 - DNA, 647 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacagcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaattta

SEQ ID NO: 2352 - DNA, 644 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcccttttcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaattgtgaaagttataactattaacttttgactaaacttgaaaaaatcacatttttgatgtggaaccaaatctgattttgagaaccaagtttgattttgatggattttgcaggagaattagccacaagaactcaccatcaaaatcatggacacattgagaaggatgaatcctgggttccagtatgtgattaactacttcctctatagttatttttgattcaattaaatttattta

SEQ ID NO: 2353 - DNA, 612 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttcaaacactcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgattttgagaaccaagttgattttgatggattttgcaggagaattagccacagaactcaccatcaaaatcatggacacattgagaaggatgaatcctgggttccagtatgtgattaactacttcctctatagttatttttga

SEQ ID NO: 2354 - DNA, 595 bp, Artificial
  Glycine max FAD3A mutation created with TALEN pair GmFAD3_T02.1
  misc_feature (409): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcgagctcggtacctcgcgaatgcatctagatccaatgatcatgagcggagaattaagggagtcacgttatgacccccgccgatgacgcgggacaagccgttttacgtttggaactgacagaaccgcaacgttgaaggagccactcagccgcgggtttctggagtttaatgagctaagcattcctcaattcttgtgccataccatggatggttagttcatcccggcttttttgtttgncattgggaagttcttttattgattcaattttaatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgttt

SEQ ID NO: 2355 - DNA, 728 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttattttatttaataagttcaagaaaaatggaatctttatacttcagataaagctgttcttgaacattttttttcgtcattatct

SEQ ID NO: 2356 - DNA, 717 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaaataaagtttcaagaaaaaggaatctttatacttcagataaagctgttcttgaacattttttttgtc

SEQ ID NO: 2357 - DNA, 729 bp, Artificial
  Glycine max FAD3A mutation created with TALEN pair GmFAD3_T02.1
  misc_feature (675): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacattcctcaattcttgtgccataccatggatggttagttcatcccggcttttttgtttgtcattggaagttcttttattgatttaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttataagttcaagaaaaatggaatctttntacttcagataaagctgttcttgaacattttttttcgtcattatctagttaacc

SEQ ID NO: 2358 - DNA, 585 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacaattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaaagttataaacttttagcttcattgtcattgaaagttcttttattaaattatatttttattgcgtgtttggaatcccatttgagaaataagaaaatcacgtttaaaaatgtgaaagttataactattaacttttgactaaaacttgaaaaaaatcacattttgatgtggaaccaaatctgatttgagaaccaagttgattttgaatggattttgcaggagaattagccacagaactcaccatcaaaatcatggacacattgagaaggatg

SEQ ID NO: 2359 - DNA, 685 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggatcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaaatttatttatttaataagttcaagaaaaaaaggaatctttatacttcaga

SEQ ID NO: 2360 - DNA, 733 bp, Artificial
  Glycine max FAD3A mutation created with TALEN pair GmFAD3_T02.1
  misc_feature (678): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaatttatttatttaataagttcaagaaaaatggaatctttntacttcagataaagctgttcttgaacattttttttcgtcattatctagttaaccg

SEQ ID NO: 2361 - DNA, 733 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacagcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacattttttttgtcattatcttagttaa

SEQ ID NO: 2362 - DNA, 724 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatgcaaatatttcttgtcaaaaatgctccactgacgttccataaattcccctcggtatccaattagagtctcatcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataatctattaacttttgactaaacttgaaaaaaactcacatttttgatgtggaaccaaaattctgatttgagaaccaagttgattttgatggattttgcaggagaattagccacagaactcaccatcaaaatcatggacacattgagaagggatgaatcctgggttccagtatgtgattaactacttcctctatagttattttttggattcaattt

SEQ ID NO: 2363 - DNA, 622 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatag

SEQ ID NO: 2364 - DNA, 734 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggagcattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatatgttatttttgattcaattaaatttattttatttaataagttcaagaaaaaaggaatctttatacttcagataaagctgttcttgaacattttttttgtcattatcttagttaaccg

SEQ ID NO: 2365 - DNA, 745 bp, Artificial
  Glycine max FAD3A mutation created with TALEN pair GmFAD3_T02.1
  misc_feature (691); (736): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacaccctgggggtgcctaatgagtgagctaactcacattaattgcgttgcgctcactgcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggatttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttntacttcagataaagctgttcttgaacattttttttgtcattatcnagttaaccg

SEQ ID NO: 2366 - DNA, 738 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttgtcattatctagttaaccga

SEQ ID NO: 2367 - DNA, 636 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatgggatggttagttcatcccggcttttttgtttgtcattggaagttcttttattgattcaatttttatagcgtgttcggaaacgcgtttcagaaaaattaatgaaatacatcttgaatctgaaagttataacttttagcttcattgtcattgaaagttcttttattaattatatttttattgcgtgtttggaatcccatttgagaaataagaaatcacgtttaaaatgtgaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagtatttttgattcaa

SEQ ID NO: 2368 - DNA, 744 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatctgcgcacatttccccgaaaagtgccacctgacgtctaagaaaccattattatcatgacattaacctataaaaataggcgtatcacgaggccctttcgtgtcgcgcgtttcggtgatgacttgcattcctcaattcttgtgccataccatggatggttagttcatcccggctttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatattttattgcgtgtttggaatcccatttgagaaataagaaatcacgtttaaaatgtgaaagttataactattaactttgactaaaacttgaaaaaatcacatttttgatgtggaaccaaatctgatttgagaaccaagttgattttgatggattttgcaggagaattagccacagaactcaccatcaaaatcatggacacaattgagaaggatgaatcctgggttccagtatgtgattaagctacttcctcatat

SEQ ID NO: 2369 - DNA, 734 bp, Artificial; identical to SEQ ID NO: 1725
  Glycine max FAD3A mutation created with TALEN pair GmFAD3_T02.1
  misc_feature (680): n is a or c or t or g

SEQ ID NO: 2370 - DNA, 714 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtggggcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaatgtgaaagttataactattaacttttgactaaacttgaaaaaattcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaagggaatctttatacttcagataaagctgttcttgaacatttttttt

SEQ ID NO: 2371 - DNA, 737 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttcgtcattatctagttaaccg

SEQ ID NO: 2372 - DNA, 733 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcccttttcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcatttgtcattgaaaagttctttttattaattatatttttattgcgtgtttggaatcccatttgagaaataagaaatcacgtttaaaattgtgaaagttataactattaacttttgactaaacttgaaaaaactcacattttttgattgtggaaccaaatctgattttgagaaccaagttgatttgatggattttgcaggagaattagccacagaactcaccatcaaaatcatggacacattgagaaggatgaatcctgggttccagtatgtgattaactacttcctctatagttatttttggattcaattaaatttatttatttaataagttcaagaaaaagggaatctttatacttcagataaagctgattcttgaacatttttttagtcattatcttagttaaccg

SEQ ID NO: 2373 - DNA, 769 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacaggccaacttctcaagattgcaaaacgtggcggcgtgaccgcagtggaggcagtgcatgcatggcgcaatgcactgacgggtgcccgctcaacttgacccccagcaggtggtggccatcgccagcaataatggttgcattcctcaattcttgtgccataccatggatggttagttcatcccggctttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaactttgactaaacttgaaaaatcacatttttgatgtggaaccaaatctgatttgagaaccaagttgatttttgatggattttgcaggagaattagccacagaactcaccatcaaaatcatggacacattgagaaggatgaatcctgggttccagtatgtgattaactacttcctctatagttatttttgatcaat

SEQ ID NO: 2374 - DNA, 705 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaa

SEQ ID NO: 2375 - DNA, 733 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacagcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttgtcattatctagttaacc

SEQ ID NO: 2376 - DNA, 615 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaaacttcaccatcaaaatcatggacacattgagaaggatgaatcctgggttccagtatgtgattaactactt

SEQ ID NO: 2377 - DNA, 815 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcccctcgagcactccctcgtgcgctctcctgttccgaccctgccgcttaccggatacctgtccgcctttctcttgcattcctcaattcttgtgccataccatggatggttagttcatcccggctttttgtttgtcatggaagttcttttattgattcaatttttatagcgtgtcggaaaacgcgtttcagaaaataatgaaatacatcttgaatctgaaagttataacttttagctcattgtcattgaaagttcttttattaattatatttttattgcgtgtttggaatcccatttgagaaataagaaaatcacgtttaaaatgtgaaagttataactattaactttgactaaacttgaaaaaattcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaacggaatctttatacttcagataaaggctgttcttgaacatttttttcgtcattatcttagttaaccgagaag

SEQ ID NO: 2378 - DNA, 730 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacatgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataaagtttcaagaaaaaatggaatctttataacttcagataaagctgttcttgaacattttttttgtcattatc

SEQ ID NO: 2379 - DNA, 704 bp, Artificial
  Glycine max FAD3A mutation created with TALEN pair GmFAD3_T02.1
  misc_feature (682): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggatgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaacctacttcctctatagttatttttgattcaattaaatttattttatttataagttcaagaaaaaggaatctttntacttcagataaagctgttctt

SEQ ID NO: 2380 - DNA, 734 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggagcattcctcaattcttgtgccataccatggatggttagttcatcccggcttttttgtttgtcattggaagttctttttattgattcaatttttatagcgtgttcggaaacgcgtttcagaaaattaatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaaacttgaaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaacctacttcctctatagttatttttcgattcaattaatttatttatttataagttcaagaaaaatggaatcttatacttcagataaagctgttctttgaacatttttttttcgtcattatcttaag

SEQ ID NO: 2381 - DNA, 724 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataagctgttcttgaacatttttttgtcattatctt

SEQ ID NO: 2382 - DNA, 696 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatattttattgcgtgtttggaatcccatttgagaaataagaaatcacgtttaaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttattaataagttcaagaaaaaggaatctttatacttcagataaagctgttcttgaacattttttt

SEQ ID NO: 2383 - DNA, 537 bp, Artificial
  Glycine max FAD3A mutation created with TALEN pair GmFAD3_T02.1
  misc_feature (391): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaaagttataactattaacttttgactaaaacttgaaaaaatcacatttttgatgnggaaccaaatctgatttgagaaccaagttgattttgatggattttgcaggaagaattagccacagaactcaccatcaaaatcatggacacattgagaaggatgaatcctggttccagtatgtgattaactacttcctctatagtta

SEQ ID NO: 2384 - DNA, 737 bp, Artificial; identical to SEQ ID NO: 2054
  Glycine max FAD3A mutation created with TALEN pair GmFAD3_T02.1
  misc_feature (682): n is a or c or t or g

SEQ ID NO: 2385 - DNA, 734 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttataagttcaagaaaaatggaatctttatacttcagataaagctgttcttgaacattttttttcgtcattatctagttaaccg

SEQ ID NO: 2386 - DNA, 739 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggaaattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaatgtgaaagttataactattaacttttgactaaacttgaaaaaattcacatttttgatgtggaaccaaatctgatttgagaaccaagttgattttgatggattttgcaggagaattagccacagaactcaccatcaaaattcatggacacattgagaaggatgaatcctgggttccagtatgtgattaactacttcctctatagttatttttgattcaattaaatttatttatttaataagttcaagaaaaaagggaatctttatacttcagataaagctgttcttgaacattttttttagtcattatcttagttaaccgag

SEQ ID NO: 2387 - DNA, 736 bp, Artificial; identical to SEQ ID NO: 1430
  Glycine max FAD3A mutation created with TALEN pair GmFAD3_T02.1

SEQ ID NO: 2388 - DNA, 714 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacatttttttt

SEQ ID NO: 2389 - DNA, 469 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtggcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaattaagaaatcacgtttaaaatgtgaagttataactattaactttgactaaacttgaaaaaatcacatttttg

SEQ ID NO: 2390 - DNA, 734 bp, Artificial
  Glycine max FAD3A mutation created with TALEN pair GmFAD3_T02.1
  misc_feature (680): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacatgcattcctcaattcttgtgccataccatggatggttagttcatcccggcttttttgtttgtcattggaagttctttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaacctacttcctctatagttatttttgattcaattaaatttatttatttataagttcaagaaaaatggaatctttntacttcagataaagctgttcttgaacattttttttcgtcattatctagttaacc

SEQ ID NO: 2391 - DNA, 705 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcgctggagacggtccagcggctgttgccggtgctgtgccaggcccacggcttgaccccggagcaggtggtggccatcgccagccacgatggcggcaacagccgctggaccattcctcaattcttgtgccataccatggatggtttagttcatcccggcttttttgtttgtcattggaagttctttttattgattcaatttttatagcgtgttcggaaacgcgtttcagaaaataatgaaatacatcttgaatctgaaagttataacttttagcttcattgtcattgaaagttcttttattaattatatttttcattgcgtgtttggtaatcccatttgagaaattaagaaatcacgtttaaaatgtgaaagtataactattaacttttgactaaatcttgaaaaaaactcacatttttgtgtggaaccaaatctgattgagaccaagttgatttgatggattttgcaggaagaattagcacagaactcaccatcaaaatcatggacacattgagaaggatgaatcctgggttcc

SEQ ID NO: 2392 - DNA, 734 bp, Artificial
  Glycine max FAD3A mutation created with TALEN pair GmFAD3_T02.1
  misc_feature (688): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacactcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcaganaaagctgttcttgaacattttttttcgtcattatctaagttaaccg

SEQ ID NO: 2393 - DNA, 416 bp, Artificial
  Glycine max FAD3A mutation created with TALEN pair GmFAD3_T02.1
  misc_feature (168): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggancattccatcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgttt

SEQ ID NO: 2394 - DNA, 664 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggatggttagttcatcccggcttttttgtttgtcattggaagttcttttattgattcaatttttatagcgtgttcggaaacgcgttttcagaaaataatgaaatacatcttgaatctgaaagttataacttttagcttcattgtcattgaaagttcttttattaattatatttttattgcgtgtttggaatcccatttgagaaaataagaaatcacgtttaaaaatgtgaaaagttataactattaacttttgactaaacttgaaaaaatcacatttttgatgtggaaccaaatctgattgagaaccaagttgattttgatggattttgcaggagaattagccacagaactcaccatcaaaatcatggacacattgagaaggatgaatcctgggttccagtatgtgataactacttcctctatagttatttttgattcaattaaatttatttatttaataagttcaagaaaaaatggaatctttatacttcagataaagctgtcttgaacatttttttttgtcattatctagtttaaccgagaag

SEQ ID NO: 2395 - DNA, 738 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacattgccggtgctgtgccaggcccacggcttgaccccccagcaggtggtgggcattcctcaattcttgtgccataccatggatggttagttcatcccggcttttttgtttgtcattggaagttcttttattgattcaatttttatagcgtgttcggaaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagtaattagccacaatgaactcaccatcaaaatcatggacacattgagaaggatgaatcctgggttccgagtatgtgattaactacttcctctatagttatttttgattcaattaaatttatttattatagttcaagaaaaaggaatctttatacttca

SEQ ID NO: 2396 - DNA, 732 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacagcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttataagttcaagaaaaatggaatctttatacttcagataaagctgttcttgaacatttttttgtcattatctagttaaccg

SEQ ID NO: 2397 - DNA, 723 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagtttcaagaaaaaatggaatctttataattcagataaagctgttctttgaacattttttttgtcatt

SEQ ID NO: 2398 - DNA, 733 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtggcttgcattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaaatgtgaaagttataactattaacttttgactaaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacatttttttgtcattatctagttaaccg

SEQ ID NO: 2399 - DNA, 736 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacattgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttaacttcagataaagctgttcttgaaaatttttttttgtcattatctagttaaccg

SEQ ID NO: 2400 - DNA, 733 bp, Artificial; identical to SEQ ID NO: 1434
  Glycine max FAD3A mutation created with TALEN pair GmFAD3_T02.1

SEQ ID NO: 2401 - DNA, 729 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacatgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttattttatttaataagtttcaagaaaaatggaatctttatacttcagataaagctgttcttgaacattttttttcgtcattatct

SEQ ID NO: 2402 - DNA, 580 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatattgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgttttaaaatgtgaaagttataactattaacttttgactaaacttgaaaaaatcacatttttgatgtggaaccaaatctgattttgagaaccaagttgaattttgatggattttgcaggagaattagccacagaactcaccatcaaaatcatggacacattgagaaggatgaatcctggg

SEQ ID NO: 2403 - DNA, 736 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggattgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaatttatttatttaataagttcaagaaaaaggaatctttatacttcagataaagctgttcttgaacattttttttcgtcattatcttagttaaccg

SEQ ID NO: 2404 - DNA, 601 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaattgtgaaagttataactattaacttttgactaaacttgaaaaaactcacatttttgatgtggaaccaaatctgatttgagaaccaagttgatttgatggattttgcaggagaattagccacagaactcaccatcaaaatcatggacacattgagaaggatgaatcctgggttccagtatgtgattaactacttcctctatag

SEQ ID NO: 2405 - DNA, 738 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacaattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaacctcttcctctatagttatttttgattcaattaaattttattttattttaataagtttcaagaaaaaatggaatctttatacttcagataaagctgttcttgaacatttttttttcgtcattatctagttaa

SEQ ID NO: 2406 - DNA, 727 bp, Artificial
  Glycine max FAD3A mutation created with TALEN pair GmFAD3_T02.1
  misc_feature (691): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacatcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcaganaaagctgttcttgaacattttttttcgtcattatct

SEQ ID NO: 2407 - DNA, 486 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatgctggcgatggccaccacctgctggggggtcaagccgtgggcctggcacagcaccggcaacagcgcctgcaccgtctccagcgcctgcttttcctcaattcttgtgccataccatggatggttagttcatcccggctttttgtttgtcattggaagttcttttattgattcaatttttatagcgtgttcggaaacgcgtttcagaaataatgaaatacatcttgaaatctgaaagttataacttttagcttcattgtcattgaaagttcttttattaattatatttttattgcgtgtttggaatcccatttgag

SEQ ID NO: 2408 - DNA, 735 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttattttatttaataagttcaagaaaaatggaatctttatacttcagataaagctgttcttgaacattttttttcgtcattatctagttaaccg

SEQ ID NO: 2409 - DNA, 738 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacttgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttattttatttaataagttcaagaaaaatggaatctttatacttcagataaagctgttcttgaacattttttttcgtcattatctagttaaccg

SEQ ID NO: 2410 - DNA, 687 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaaatcatggacacattgagaaggatgaatcctgggtttccagtatgtgattaactacttcctctatagttattttgattcaattaaaatttatttatttaaataagttcaagaaaaaaggaatctttatacttcagataaagctgttcttgaacatttttttgtcatta

SEQ ID NO: 2411 - DNA, 663 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggactcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaagttcttttattaattatatttttattgcgtgtttggaatcccatttgagaataagaaatcacgtttaaaatgtgaagttataactattaacttttgactaaacttgaaaaaatcacatttttgatgtggaaccaaatctgatttgagaaccaagttgattttgatggattttgcaggagaatttagccacagaactcaccatcaaaatcatggacacattgagaaggatgaatcctgggttccagtatgtgattaactacttcctctatagttattttgattcaattaaatttatttatttaataagttcaagaaaaaa

SEQ ID NO: 2412 - DNA, 728 bp, Artificial; identical to SEQ ID NO: 2221
  Glycine max FAD3A mutation created with TALEN pair GmFAD3_T02.1

SEQ ID NO: 2413 - DNA, 687 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacaattcttgtgccataccatggatggttagttcatcccggcttttttgtttgtcattggaagttcttttattgattcaatttttatagcgtgttcggaaacgcgtttcagaaaataatgaaatacacttgaatctgaaaagttataacttttagcttcattgtcattgaaaagttcttttattaattatatttttattgcgtgtttggaatcccatttgagaaataagaaatcacgtttaaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaaatttatttatttaataagttcaagaaaaaaaggaatctttatacttcagataaagc

SEQ ID NO: 2414 - DNA, 738 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttattttattttaataagttcaagaaaaatggaatctttatacttcagataaagctgttcttgaacattttttttgtcattatctagttaaccg

SEQ ID NO: 2415 - DNA, 737 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaaatctttatacttcagataaagctgttcttgaacattttttttgtcattatctaagttaaccg

SEQ ID NO: 2416 - DNA, 735 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaatgtgaaagttataactattaacttttgactaaacttgaaaaaattcacatttttgatgtggaaccaaatctgatttgagaaccaagttgattttgatggattttgcaggagaattagccacagaactcaccatcaaatcgatgcatgcacattgagaaggatgaatcctgggttccagtatgtgattaactacttcctctatagttattttcgattcaattaaatttatttatttaataagttcaagaaaaagggaatcttatacttcagataaagctgttcttgaacatttttttagtcattatcttagttaaccgag

SEQ ID NO: 2417 - DNA, 734 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacatattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaaggaatctttatacttcagataaagctgttcttgaacattttttttcgtcattatcttagttaa

SEQ ID NO: 2418 - DNA, 717 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacactggccaccacctgctggggggtcaagccgtgggcctggcacagcaccggcaacagccgctgaattcttgtgccataccatggatggttagttcatcccggcttttttgtttgtcattggaagttcttttattgattcaatttttatagcgtgttcggaaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaagtcacattttgatgtggaaccaaatctgattgagaaccagttgattttgatggattttgcaggagaattagccacagaactcaccatcaaaatcatggacacattgagaaggatgaatcctgggttccagtatgtgattaactacttccctctatagttatttttcgattcaattaaatttatttatttaataagttcaa

SEQ ID NO: 2419 - DNA, 734 bp, Artificial
  Glycine max FAD3A mutation created with TALEN pair GmFAD3_T02.1
  misc_feature (679): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacttgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagtatttttgattcaattaaatttatttatttataagttcaagaaaaatggaatctttntacttcagataaagctgttcttgaacattttttttcgtcattatctagttaaccg

SEQ ID NO: 2420 - DNA, 636 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaatt

SEQ ID NO: 2421 - DNA, 556 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcgctggagacggtccagcggctgttgccggtgctgtgccaggcccacggcttgaccccggagcaggtggtggccatcgccagccacgatggcggcaacagccgctggaccattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaatcacgtttaaaatgtgaaagttataactattaacttttga

SEQ ID NO: 2422 - DNA, 730 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcgatggccaccacctgctccggggtcaagccgtgggcctggcacagcaccggcaacagccgctggaccgtctccagcgcctgcttgccaccattattgctggcgatggccaccttgcattcctcaattcttgtgccataccatggatggttagttcatcccggcttttttgtttgtcattggaagttcttttattgattcaatttttatagcgtgttcggaaacgcgtttcagaaataatgaaatacatcttgaatctgaaagttataactttagcttcattgtcattgaaagttcttttattaattatatttttattgcgtgtttggaatcccatttgagaaataagaaatcacgtttaaaatgtgaaagttataactattaacttttgactaaacttgaaaaaaatcacattttgatgtggaaccaaatctgatttgagaaccaagttgattttgatggattttgcaggagaattagccacagaactcaccatcaaaatcatggacacattgagaagggatgaatcctgggttccagtatgtgattaactacttcctctatagttattttt

SEQ ID NO: 2423 - DNA, 468 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacaatggccaccacctgctggggggtcaagccgtgggcctggcacagcaccggcaacagccgctggaccgtctccagcgcctgcttgccaccgccattgctggcgatggccaccacctgctgggggtcaagccgttgggcctggcacagcaccggcaacagccgtctggaccgtctccagcgcctgcttgccaccgcattcctcaattcttgtgccataccatggatggttagttcattcccggctttttgtttgtcattggaagttcttttattgattcaatttttatagcgtgttcgg

SEQ ID NO: 2424 - DNA, 522 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacaatggccaccacctgctggggggtcaagccgtgggcctggcacagcaccggcaacagccgctggaccgtctccagcgcctgcttgccaccgccattgctggcgatggccaccacctgctgggggtcaagccgtgggcctggcacagcaccggcaacagccgctggaccgtctccagcgcctgcttgccaccgcattcctcaattcttgtgccataccatggatggttagttcatcccggctttttgtttgtcattggaagttcttttattgattcaatttttatagcgtgttcggaaacgctgttcagaaaataatgaatacatcttgaatctgaaagttataacttttagc

SEQ ID NO: 2425 - DNA, 706 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacactgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaacctacttcctctatagttatttttgattcaattaaatttattttcatttaataagttcaagaaaaatggaactctttatacttcagataaagctgttc

SEQ ID NO: 2426 - DNA, 739 bp, Artificial
  Glycine max FAD3A mutation created with TALEN pair GmFAD3_T02.1
  misc_feature (684): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggatttgcaggagaattagccacagaactcaccatcaaaagtcatggacacattgagaaggatgaatcctgggttccagtatgtgattaactacttcctctatagttatttttgattcaattaaatttatttatttaataagttcaagaaaaatggaatctttntacttcagataaagctgttcttgaacattttttttcgtcattatctagttaaccg

SEQ ID NO: 2427 - DNA, 809 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgagaagttggcctgtgtccaactgtaacggtggacctctcaactctcccgccaccgtgagcaagtgcattcctcaattcttgtgccataccatggatggttagttcatcccggcttttttgtttgtcattggaagttcttttattgattcaatttttatagcgtgttcggaaacgcgtttcagaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaactcacatttttgatgtggaaccaaatctgatttgagaaccaagttgattttgatggattttgcaggagaattagccacagaactcaccatcaaaatcatggacacattgagaagggatgaatcctgggttccagtatgtgattactacttcctctatagttattttttggattcaattaattttatttatttaataagttcaagaaaaacggaatctttatacttcagataaagctgttcttgaaacatttttttcgtcattatctttagttaacc

SEQ ID NO: 2428 - DNA, 715 bp, Artificial; identical to SEQ ID NO: 1515
  Glycine max FAD3A mutation created with TALEN pair GmFAD3_T02.1

SEQ ID NO: 2429 - DNA, 687 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtggggcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaagttctttattaattatatttttattgcgtgtttggaatcccatttgagaataagaaatcacgtttaaaatgtgaagttataactattaacttttgactaaactgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatatgtattttgattcaattaatttatttattaataagttcaagaaaaaaggaatctttatacttcagataaagctg

SEQ ID NO: 2430 - DNA, 759 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacaggccaacttctcaagattgcaaaacgtggcggcgtgaccgcagtggaggcagtgcatgcatggcgcaatgcactgacgggtgccccgctcaacttgacccccagcaggtggtggccatcgccagcaataatggttgcattcctcaattcttgtgccataccatggatggttagttcatcccggctttttgtttgtcattggaagttcttttattgattcaattttatagcgtgttcggaaacgcgtttcagaaataatgaaatacatcttgatctgaaagttatacttttagcttcattgtcattgaaagttcttttattaattatattttattgcgtgtttggaatcccatttgagaaataagaaatcacgtttaaaatgtgaagttataactattaactttgactaaacttgaaaaatcacatttttgatgtggaaccaaatctgatttgagaaccaagttgatttttgatggattttgcaggagaattagccacagaactcaccatcaaatcatggacacattgagaaggatgaatccctgggttccagtatgtgattaactacttcctctatagttatttttga

SEQ ID NO: 2431 - DNA, 733 bp, Artificial
  Glycine max FAD3A mutation created with TALEN pair GmFAD3_T02.1
  misc_feature (678): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttataagttcaagaaaaatggaatctttntacttcagataaagctgttcttgaacattttttttcgtcattatctagttaaccg

SEQ ID NO: 2432 - DNA, 718 bp, Artificial
  Glycine max FAD3A mutation created with TALEN pair GmFAD3_T02.1
  misc_feature (683): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaagtcatggacacattgagaaggatgaatcctgggttccagtatgtgattaacctacttcctctatagttatttttgattcaattaaatttatttatttataagttcaagaaaaatggaatctttntacttcagataaagctgttcttgaacatttttttc

SEQ ID NO: 2433 - DNA, 733 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtggcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaatttagccacagaactcaccatcaaaatcatggacacattgagaaggatgaatcctgggttccagtatgtgattaactacttcctctatagttattttgattcaattaaatttatttatttaataagttcaagaaaaaaggaatctttatacttcagataaagctgttcttgaacattttttttgtcattatcttagttaaccgag

SEQ ID NO: 2434 - DNA, 557 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacaagcattcctcaattcttgtgccataccatggatggttagttcatccccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaagttataactattaacttttgactaaacttgaaaaaactcacatttttgatgtggaaccaaatctgatttgagaaccaagtttgattttgatggattttgcaggagaattagccacagaactcaccatc

SEQ ID NO: 2435 - DNA, 571 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggatgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggatgaattagccacagaactcaaccatcaaaatcatggacaa

SEQ ID NO: 2436 - DNA, 724 bp, Artificial
  Glycine max FAD3A mutation created with TALEN pair GmFAD3_T02.1
  misc_feature (681): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttntacttcagataaagctgttcttgaacatttttttgtcattatc

SEQ ID NO: 2437 - DNA, 733 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggagcattcctcaattcttgtgccataccatggatggttagttcatcccggcttttttgtttgtcattggaagttctttttattgatcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaaggaatctttatacttcagataaagctgttcttgaacattttttttcgtcattatcttagttaacc

SEQ ID NO: 2438 - DNA, 734 bp, Artificial; identical to SEQ ID NO: 1489
  Glycine max FAD3A mutation created with TALEN pair GmFAD3_T02.1
  misc_feature (681): n is a or c or t or g

SEQ ID NO: 2439 - DNA, 611 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggaagcattcctcaattcttgtgccataccatggatggttagttcatcccggcttttttcgttttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacatttttgatgtggaaccaaaatctgatttgagaaccaagttgattttgatggattttgcaggagaattagccacagaactcaccatcaaaagtcatggacacattgagaaggatgaatcctgggttccagtatgtgattaa

SEQ ID NO: 2440 - DNA, 644 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaacctacttcctctatagttatttttgattcaattaaattta

SEQ ID NO: 2441 - DNA, 724 bp, Artificial
  Glycine max FAD3A mutation created with TALEN pair GmFAD3_T02.1
cactgctttgttaatgcctacctcatttcatttggctttagacaacttaaatttgagatctttattatgttttttgcttatatggtaaagtgattcattcttcacattgaattgaacagtggccatggaagcttttcagacagcccttttctaaatagcctggtggggcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaataagaaatcacgtttaaaatgtgaagttataactattaacttttgactaaacttgaaaaaattcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttattaataagttcaagaaaaaggaatctttatacttcagataaagctgttcttgaacatttttttagtcattatcttag

SEQ ID NO: 2442 - DNA, 653 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaactcacatttttgatgtggaaccaaatctgatttgagaaccaagttgattttgatggattttgcaggagaattagccacagaactcaccatcaaaagtcatggacacattgagaaggatgaatcctgggttccagtatgtgattaacctacttcctctatagttatttttgattcaattaatttattt

SEQ ID NO: 2443 - DNA, 737 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacagcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttcgtcattatctagttaaccg

SEQ ID NO: 2444 - DNA, 737 bp, Artificial; identical to SEQ ID NO: 2443
  Glycine max FAD3A mutation created with TALEN pair GmFAD3_T02.1

SEQ ID NO: 2445 - DNA, 670 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggaattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaatgtgaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaggaatc

SEQ ID NO: 2446 - DNA, 733 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccgagtatgtgattaactacttcctctatagttatttttgattcaattaaatttatttatttaataagttcaagaaaaatggaatctttatacttcagataaagctgttcttgaacatttttttgtcattatctagttaaccg

SEQ ID NO: 2447 - DNA, 731 bp, Artificial
  Glycine max FAD3A mutation created with TALEN pair GmFAD3_T02.1
  misc_feature (676): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttataagttcaagaaaaatggaatctttntacttcagataaagctgttcttgaacattttttttcgtcattatctagttaaccg

SEQ ID NO: 2448 - DNA, 718 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacttcctcaattcttgtgccataccatggatggttagttcatcccggcttttttgtttgtcattggaagtttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacattttttttgtca

SEQ ID NO: 2449 - DNA, 733 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttgtcattatctaagttaacc

SEQ ID NO: 2450 - DNA, 738 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggatgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttattttatttaataagttcaagaaaaaaggaatctttatacttcagataaagctgttcttgaacattttttttcgtcattatcttagttaaccg

SEQ ID NO: 2451 - DNA, 650 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacaagcattcctcaattcttgtgccataccatggatggttagttcatcccggcttttttgtttgtcattggaagttctttttattgaattcaatttttatagcgtgttcggaaacgcgtttcagaaaataatgaaaatacatcttgaatctgaaaagttataacttttagctttcattgtcattgaaagttcttttattaattatatttttatgcgtgtttggaatcccatttgagaaataagaaatcacgtttaaaatgtgaaagttataactattaacttttgactaaacttgaaaaaatcaacattttgatgtggaaccaaaatctgatttgagaaccaagtttgattttgatggattttgcaggagaattagccacagaaactcaccatcaaaaatcatggacacaattgagaaggatgaatcctgggttccagtatgtgattaactacttcctctatagttatttttgattcaattaaa

SEQ ID NO: 2452 - DNA, 736 bp, Artificial
  Glycine max FAD3A mutation created with TALEN pair GmFAD3_T02.1
  misc_feature (682): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacactgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttntacttcagataaagctgttcttgaacattttttttcgtcattatctagttaacc

SEQ ID NO: 2453 - DNA, 649 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggatgcattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattatgccacagaactcaccatcaaaatcatggacacattgagaaggatgaatcctgggttccagtatgtgattaacctacttcctctatagttatttttgattcaattaatttattta

SEQ ID NO: 2454 - DNA, 736 bp, Artificial
  Glycine max FAD3A mutation created with TALEN pair GmFAD3_T02.1
  misc_feature (682): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttataagttcaagaaaaatggaatctttntacttcagataaagctgttcttgaacattttttttcgtcattatctagttaacc

SEQ ID NO: 2455 - DNA, 717 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacactattgctggcgatggccaccacctgctccggggtcaagccgtgggcctggcacagcaccggcaacagcgcctggaccgtctccagcgcctgcttgccaccaactcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatattttattgcgtgttggaatcccatttgagaaataagaaatcacgtttaaaatgtgaaagttataactattaactttgactaaacttgaaaaaatcacatttttgatgtggaaccaaatctgatttgagaaccaagttgaattttgatggattttgcaggagaattagccacagaactcaccatcaaaatcatggacacattgagaaggatgaatcctgggttccagtatgtgattaactacttcctctatagtt

SEQ ID NO: 2456 - DNA, 619 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctct

SEQ ID NO: 2457 - DNA, 697 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacttgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaatttatttatttaataagttcaagaaaaaggaatctatacttcagataaagctgttc

SEQ ID NO: 2458 - DNA, 676 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtggtcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaatttagccacagaactcaccatcaaaatcatggacacattgagaaggatgaatcctgggttccagtatgtgattaactacttcctctatagttattttgattcaattaaatttatttatttaataagttcaagaaaaaaggaatctttatacttca

SEQ ID NO: 2459 - DNA, 694 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggaattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaaaggaatctttatacttcagataaagctg

SEQ ID NO: 2460 - DNA, 742 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatactcagataaagctgttctttgaacattttttttgtcattatctaagttaaccgagaa

SEQ ID NO: 2461 - DNA, 724 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggagcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaaggaatctttatacttcagataaagctgttcttgaacattttttttgtcattatctt

SEQ ID NO: 2462 - DNA, 735 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacagcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatactcagataaagctgttcttgaacatttttttcgtcattatctagttaaccg

SEQ ID NO: 2463 - DNA, 634 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacaatggccaccacctgctggggggtcaagccgtgggcctggcacagcaccggcaatcagccgctggaccgtctccagcgcctgcttgccaccgccattgctggcgatggccaccacctgctgggggtcaagccgtgggcctggcacagcaccggcaacagccgtctggaccgtctccagcgcctgcttgccaccgcattctcaattcttgtgccataccatggatggtagttcatcccggctttttgtttgtcattggaagttcttttattgattcaatttttatagcgtgttcggaaacgcgttcagaaaataatgaatacatcttgaatctgaagttataacttttagcttcattgtcattgaaaagttctttattaattatattttattgcgtgtttggaatcccatttgagaaataagaaatcacgtttaaaatgtgaaagtttataactattaactttga

SEQ ID NO: 2464 - DNA, 734 bp, Artificial
  Glycine max FAD3A mutation created with TALEN pair GmFAD3_T02.1
  misc_feature (679): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttataagttcaagaaaaatggaatctttntacttcagataaagctgttcttgaacattttttttcgtcattatctagttaaccg

SEQ ID NO: 2465 - DNA, 733 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacaattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaaggaatctttatacttcagataaagctgttcttgaacattttttttgtcattatcttagttaacc

SEQ ID NO: 2466 - DNA, 696 bp, Artificial
  Glycine max FAD3A mutation created with TALEN pair GmFAD3_T02.1
  misc_feature (286): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggagcgcagcgagtcagtgagcgaggaagcggaagagcgcccaatacgcaaaccgcctcttgcattcctcaattcttgtgccataccatggatggttagttcatcccggcttttttgtttgncattggaagttcttttattgattcaatttttaatagcgtgttcggaaacgcgtttcagaaaataatgaaatacatcttgaatctgaaagttataacttttagcttcattgtcattgaaagttcttttattaattatatttttattgcgtgtttggaatccatttgagaaataagaaatcacgtttaaatgtgaaagttataactattaacttttgactaaacttgaaaaaaatcatcattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaa

SEQ ID NO: 2467 - DNA, 680 bp, Artificial
  Glycine max FAD3A mutation created with TALEN pair GmFAD3_T02.1
  misc_feature (672): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacgcattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagtatttttgattcaattaaatttatttatttaataagttcaagaaaaatggaanctttatac

SEQ ID NO: 2468 - DNA, 616 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcccttttcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaaacttgaaaaaatcacatttttgatgtggaaccaaattctgattttgagaaccaagttgaatttgatggattttgcaggagaattagccacagaactcacattcaaaatcatggacacattgagaaggatgaatcctgggttccagtatgtgattaactacttcctctatagtta

SEQ ID NO: 2469 - DNA, 678 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacagcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaatttatttatttataagttcaagaaaaatggaatcttt

SEQ ID NO: 2470 - DNA, 731 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttgtcattatctagttaaccg

SEQ ID NO: 2471 - DNA, 740 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaacctacttcctctatagttatttttgattcaattaaatttatttatttaataagttcaagaaaaaggaatctttatacttcagataaagctgttcttgaacattttttttcgtcattatcttagttaaccgagaa

SEQ ID NO: 2472 - DNA, 733 bp, Artificial
  Glycine max FAD3A mutation created with TALEN pair GmFAD3_T02.1
  misc_feature (680): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacaacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttntacttcagataaagctgttcttgaacatttttttcgtcattatctagttaacc

SEQ ID NO: 2473 - DNA, 793 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgagatcctttttttctgcgcgtaatctgctgcttgcaaacaaaaaaccaccgcttcctcaattcttgtgccataccatggatggttagttcatcccggcttttttgtttgtcattggaagttcttttattgattcaatttttatagcgtgttcggaaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttataagttcaagaaaaaagggaatctttatacttcagataaagctgttcttgaacattttttttgtcattattctagtttaaccga

SEQ ID NO: 2474 - DNA, 720 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacagcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttgtca

SEQ ID NO: 2475 - DNA, 843 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcgatggccaccacctgctccggggtcaagccgtgggcctggcacagcaccggcaacagccgctggaccgtctccagcgcctgcttgccaccattattgctggcgatggccaccttgcattcctcaattcttgtgccataccatggatggttagttcatcccggcttttttgtttgtcattggaagttcttttattgattcaatttttatagcgtgttcggaaacgcgtttcagaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaactcacatttttgatgtggaaccaaattctgatttgagaaccaagttgattttgatggattttgcaggagaattagccacagaactcaccatcaaaatcatggacacattgagaagggatgaatcctgggttccagtatgtgattaactacttcctctatagttattttttggattcaattaattttatttatttaataagttcaagaaaaacggaatctttatacttcagataaagctgttcttgaaacattttttttcgtcattatcttagttaacc

SEQ ID NO: 2476 - DNA, 714 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaagttcttttattaattatattttattgcgtgtttggaatcccatttgagaaataagaaatcacgtttaaaaattgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaagggaatctttatacttcagataaagctgttcttgaacatttttttagtcattatcttagttaaccgag

SEQ ID NO: 2477 - DNA, 721 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacagagttcttgaagtggtggcctaactacggctacactagaagaacagtatttggtatctgcgctctgctgaagccagttaccttcggaaaaagagttggtagctcttgccaccattattgcacattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggtaatcccatttgagaaataagaaatcacgtttaaaatgtgaaagtataactattaacttttgactaaacttgaaaaaaatcacattttgatgtggaaccaaatctgatttgagaaccaagttgatttgatggattttgcaggagaattagccacagaactcaccatcaaaatcatggacacattgagaaggatgaatcctgggttccaagtatgtga

SEQ ID NO: 2478 - DNA, 739 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaaacttgaaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttaatttatttaataaagttcaagaaaaatggaaatctttataacttcagataaagctgttcttgaacattttttttgtcattatctagttaaccg

SEQ ID NO: 2479 - DNA, 735 bp, Artificial
  Glycine max FAD3A mutation created with TALEN pair GmFAD3_T02.1
  misc_feature (680): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttntacttcagataaagctgttcttgaacattttttttcgtcattatctagttaaccg

SEQ ID NO: 2480 - DNA, 635 bp, Artificial
  Glycine max FAD3A mutation created with TALEN pair GmFAD3_T02.1
  misc_feature (470): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggttcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaactgtgaagttataactattaacttttgactaaactgaaaaaattcacatttttgntgtggaaccaaatctgatttgagaaccaatgttgattttgatggattttgcaggagaatttagccacagaactcaccatcaaaattcatggacacattgagaaggatgaatcctgggttccagtatgtgattaactacttcctctatagttatttttcgattcaa

SEQ ID NO: 2481 - DNA, 737 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtggcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaatgtgaaagttataactattaacttttgactaaacttgaaaaaattcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttcgattcaattaaatttatttatttaataagttcaagaaaaaagggaatctttatacttcagataaagctgttcttgaacattttttttagtcattatcttagttaaccgag

SEQ ID NO: 2482 - DNA, 557 bp, Artificial
  Glycine max FAD3A mutation created with TALEN pair GmFAD3_T02.1
cactgctttgttatgccacctcatttcatttggctttagacaacttaaatttgagatctttattatgttttttgcttatatggtaaagtgattcattcttcacattgaattgaacagtggccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaaatgtgaaaagttataactattaacttttgactaaacttgaaaaaagtcacatttttgatgtggaaccaaatctgattgagaaccaagttgattttgatggattttgcaggagaattagccacagaactcaccatcaaaatcatggacacattgagaaggatgaatcctgggttccagtatgtgattaactacttcctctatagttattttt

SEQ ID NO: 2483 - DNA, 725 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtggttgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttattttatttaataagttcaagaaaaaatggaatctttatacttcagataaagctgttcttgaacattttttttgtcattatct

SEQ ID NO: 2484 - DNA, 578 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggcactggaagcttttcagacagcccttttctaaatagcctggtgggacacatcagcaccggcaacagccgctggaccgtctccagcgcctgcttgccaccattattgctggcgatggccaccacctgctggggggtcaagccgtgggcctggttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttattaattatatttttattgcgtgtttggaatcccatttgagaatagaaatcacgtttaaaatgtgaaagttataactattaacttttgactaaacttgaaaaagtcacatttttgatg

SEQ ID NO: 2485 - DNA, 625 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacgcattcctcaattcttgtgccataccatggatggttagttcatcccggcttttttgtttgtcattggaagttctttttattgattcaatttttatagcgtgttcggaaacgcgtttcagaaaattaatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaaacttgaaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatag

SEQ ID NO: 2486 - DNA, 730 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagccctttagacaacttatatttgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttattttatttaataagttcaagaaaaaaggaatctttatacttcagataaagctgttcttgaacattttttttgtcattatcttagttaaccg

SEQ ID NO: 2487 - DNA, 742 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggatttgcaggagaattagccacagaactcaccatcaaaatcatggacacattgagaaggatgaatcctgggttccagtatgtgattaactacttctctatagttatttttgattcaattaaatttatttatttaaataagtttcaagaaaaataggaaatctttatacttcagataaagctgttctttgaacatttttttgtcattatctaagttaaccgagaa

SEQ ID NO: 2488 - DNA, 733 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacactattgctggcgatggccaccacctgctccggggtcaagccgtgggcctggcacagcaccggcaacagcgcctggaccgtctccagcgcctgcttgccaccaactcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatattttattgcgtgttggaatcccatttgagaaataagaaatcacgtttaaaatgtgaaagttataactattaactttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaa

SEQ ID NO: 2489 - DNA, 547 bp, Artificial
  Glycine max FAD3A mutation created with TALEN pair GmFAD3_T02.1
actgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgtaaagttcttttatttaattatatttttattgcgtgtttggaatcccatttgagaaataagaaatcacgtttaaaatgtgaaagttataactaattaacattttgacttaaacttgaaaaaatcacattttgatgtggaaccaaatctgatttgagaaccaagttgattttgatggatttgcaggagaattagccacagaac

SEQ ID NO: 2490 - DNA, 736 bp, Artificial
  Glycine max FAD3A mutation created with TALEN pair GmFAD3_T02.1
  misc_feature (681): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacagcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttntacttcagataaagctgttcttgaacattttttttcgtcattatctagttaaccg

SEQ ID NO: 2491 - DNA, 737 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacattttttttgtcattatcttagttaaccg

SEQ ID NO: 2492 - DNA, 710 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggatcgccagcaataatggtggcaagcaggcgctggagacggtccagcggctgttgccggtgctgtgccaggcccattcctcaattcttgtgccataccatggatggttagttcatcccggcttttttgtttgtcattggaagttcttttattgattcaatttttaatagcgtgttcggaaacgcgtttcagaaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaattcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaa

SEQ ID NO: 2493 - DNA, 563 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacactggaccgtctccagcgcctggttgccaccgccattgctggcgatggccaccacctgctgggggtcaagccgtgggcctggagacggtccagcggctgttcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataactttagcttcattgtcattgaaagttctttattaattatatttttattgcgtgtttggaatcccatttgagaaataagaaatcacgtttaaaagtgtgaaagttataactattaacttttgactaaacttgaaaaaaactcaca

SEQ ID NO: 2494 - DNA, 726 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacactgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggatttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttgtcattatct

SEQ ID NO: 2495 - DNA, 658 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaaatcatttatgttttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttattatttaataagttcaagaaaaatggatctttatacttcagataaagctgttcttgaacattttttttagtcattattcttagttaaccgagaatg

SEQ ID NO: 2496 - DNA, 725 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacactgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggatttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttgtcattatc

SEQ ID NO: 2497 - DNA, 622 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgcattcctcaattcttgtgccataccatggatggttagttcatcccggcttttttgtttgtcattggaagttcttttattgattcaatttttatagcgtgttcggaaacgcgtttcagaaaactaatgaaatacatcttgaatctgaaaagttataacttttagcttcattgtcattgaaaagttcttttattaattatatttttattgcgtgtttggaatcccatttgagaaataagaaatcacgtttaaaatgtgaagttataactattaacttttgactaaatcttgaaaaaattcacatttttgatgtggaaccaaatctgattgagaaccaagttgatttttgatggattttgcaggagaattagccacagaactcaccatcaaaattcatggacacattgagaaggtatgaatcctgggttccagtatgtgattaactacttcctctatagtt

SEQ ID NO: 2498 - DNA, 728 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacattgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactaccttcctctatagttatttttgattcaattaaatttatttatttaataagttcaagaaaaatggaatctttatacttcagataaagctgttcttgaacattttttttgtcattatct

SEQ ID NO: 2499 - DNA, 737 bp, Artificial
  Glycine max FAD3A mutation created with TALEN pair GmFAD3_T02.1
cactgctttattatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataactttttagcttcattgtcattgaaaagttcttttattaattatatttttattgcgtgtttggaatcccatttgagaaataagaaatcacgtttaaaaatgtgaaagttataactattaacttttgactaaacttgaaaaaattcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaaggaatctttatacttcagataaagctgattcttgaacatttttttgtcattatcttagttaaccgag

SEQ ID NO: 2500 - DNA, 692 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaatttatttatttaataagttcaagaaaaaggaatcttatacttcagataaagctgttc

SEQ ID NO: 2501 - DNA, 740 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaacagccctttgttattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataactttttagcttcattgtcattgaaaagttcttttattaattatatttttattgcgtgttttggaatcccatttgagaaataagaaatcacgtttaaaaatgtgaaagttataactattaacttttgactaaacttgaaaaaattcacatttttgatgtggaaccaaatctgatttgagaaccaagttgattttgatggattttgcaggagaatttagccacagaactcaccatcaaaatcatggacacattgagaaggatgaatcctgggttccagtatgtgattaactacttcctctatagttatttttgattcaattaaatttatttatttaataagttcaagaaaaaagggaatctttatacttcagataaagctgttcttgaacattttttttagtcattatcttagttaaccgag

SEQ ID NO: 2502 - DNA, 721 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatgctggcgatggccaccacctgctggggggtcaagccgtgggcctggcacagcaccggcaacagcgcctgcaccgtctccagcgcctgcttttcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatattttattgcgtgttggaatccccatttgagaataagaatcacgtttaaatgtgaagttataactattaactttagactaaacttgaaaaagtcacattttgatgtggaaccaaatctgatttgagaaccaagttgattttgatggattttgcaggagaattagccacagaactcaccatcaaaatcatggacacattgagaagggatgaatcctgggttccagtatgtgattaactacttcctctatagttatttttggattcaa

SEQ ID NO: 2503 - DNA, 603 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggatgaattagccacagaactcaccatcaaatcatggacaacattgacgaaggatgaatcctgggttccagtatgtg

SEQ ID NO: 2504 - DNA, 733 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaatgtgaaagttataactattaacttttgactaaacttgaaaaaattcacatttttgatgtggaaccaaatctgatttgagaaccaagttgattttgatggattttgcaggagaattagccacagaactcaccatcaaaattcatggacacattgagaaggatgaatcctgggttccagtatgtgattaactacttcctctatagttattttgattcaattaaatttatttattaataagttcaagaaaaaagggaatctttatacttcagataaagctgttcttgaacatttttttagtcattatcttagttaaccgag

SEQ ID NO: 2505 - DNA, 663 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttcgattcaattaaatttatttatttaataagtt

SEQ ID NO: 2506 - DNA, 605 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgatt

SEQ ID NO: 2507 - DNA, 740 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcctttagacaagctgtgaccgtgtccgggagcttgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaaacttgaaaaaaactcacatttttgatgtggaaccaaaatctgatttgagaaccaagttgattttgatggattttgcaggagaattagccacagaaactcaccatcaaaagtcatggacacattgagaaggatgaatcctgggttccagtatgtgattaacctacttcctctatagttatttttgattcaattaaatttatttatttataagttcaagaaaaatggaatctttatacttcagataaagctgttctgaacatttttttttcgtcattatcttagttaacctg

SEQ ID NO: 2508 - DNA, 739 bp, Artificial
  Glycine max FAD3A mutation created with TALEN pair GmFAD3_T02.1
  misc_feature (684): n is a or c or t or g
cactgctttgttatgcctacctcatttcatttggctttagacaacttaaatttgagatctttattatgttttttgcttatatggtaaagtgattcattccttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttntacttcagataaagctgttcttgaacattttttttcgtcattatctagttaaccg

SEQ ID NO: 2509 - DNA, 737 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaacctacttcctctatagttatttttgattcaattaatttatttatttaataagttcaagaaaaatggaatctttatacttcagataaagctgttcttgaacattttttttcgtcattatctagttaaccg

SEQ ID NO: 2510 - DNA, 733 bp, Artificial; identical to SEQ ID NO: 1777
  Glycine max FAD3A mutation created with TALEN pair GmFAD3_T02.1

SEQ ID NO: 2511 - DNA, 708 bp, Artificial
  Glycine max FAD3A mutation created with TALEN pair GmFAD3_T02.1
  misc_feature (681): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaacttcaccatcaaaatcatggacacattgagaaggatgaatcctgggttccagtatgtgattaactacttcctctatagttatttttgattcaattaaatttatttatttataagttcaagaaaaatggaatctttntacttcagataaagctgttcttgaaca

SEQ ID NO: 2512 - DNA, 563 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacattcctcaattcttgtgccataccatggatggttagttcatccccggctttttttgtttgtcattggaagttctttttattgattcaatttttatagcgtgttcggaaacgcgtttcagaaaattaatgaaaatacatcttgaatctgaaagttataacttttagcttcattgtcattgaaagttcttttattaattatatttttattgcgtgtttggaatcccatttgagaaataagaaatcacgtttaaaattgtgaaatgttataactattaactttttgactaaaacttgaaaaaaactcacatttttgatgtggaaccaaaatctgatttgagaaccaagttgattttgatggattttgcaggagaattagccacagaactcaccatc

SEQ ID NO: 2513 - DNA, 738 bp, Artificial; identical to SEQ ID NO: 1795
  Glycine max FAD3A mutation created with TALEN pair GmFAD3_T02.1

SEQ ID NO: 2514 - DNA, 725 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacactgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggatttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacatttttttgtcattatct

SEQ ID NO: 2515 - DNA, 697 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaatttatttatttaataagttcaagaaaaaggaatctttatacttcagataaagctgttc

SEQ ID NO: 2516 - DNA, 716 bp, Artificial
  Glycine max FAD3A mutation created with TALEN pair GmFAD3_T02.1
cactgctttgttaatgcctacctcatttcatttggctttagacaacttaaatttgagatctttattatgttttttgcttatatggtaaagtgattcattcttcacattgaattgaacagtggccatggaagcttttcagacagcccttttctaaatagcctggtggggcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaatgtgaaagttataactattaacttttgactaaacttgaaaaaattcacatttttgatgtggaaccaaatctgatttgagaaccaagttgattttgatggattttgcaggagaatttagccacagaactcaccatcaaaatcatggacacattgagaaggatgaatcctgggttccagtatgtgattaactacttcctctatagttatttttgattcaattaaatttatttatttaataagttcaagaaaaaagggaatctttatacttcagataaagctgttcttgaacattttttt

SEQ ID NO: 2517 - DNA, 714 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacatgcattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacatttttttt

SEQ ID NO: 2518 - DNA, 736 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacagcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggatttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatactcagataaagctgttctttgaacattttttttcgtcattatctagttaaccg

SEQ ID NO: 2519 - DNA, 726 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccattatgtgattaactacttcctctatagttatttttgattcaattaaatttatttatttaataagttcaagaaaaatggaatctttatacttcagataaagctgttcttgaacattttttttgtcattatct

SEQ ID NO: 2520 - DNA, 738 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaaatgtgaaagttataactattaacttttgactaaacttgaaaaaattcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaagggaatctttatacttcagataaagctgttcttgaacattttttttagtcattatcttagttaaccgag

SEQ ID NO: 2521 - DNA, 732 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaatcacatttttgatgtggaaccaaaatctgatttgagaaccaagttgattttgatggattttgcaggagaattagccacagaaactcaccatcaaaatcatggacacattgagaaggatgaatcctgggttccagtatgtgattaactacttcctctatagttatttttgattcaattaaatttatttatttaataagttcaagaaaaataggaaatctttatacttcagataaaagctgttcttgaacattttttttgtcattatct

SEQ ID NO: 2522 - DNA, 642 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatgcaaatatttcttgtcaaaaatgctccactgacgttccataaattcccctcggtatccaattagagtctcatcttgcattcctcaattcttgtgccataccatggatggttagttcatcccggctttttgtttgtcattggaagttcttttattgattcaatttttatagcgtgttcggaaacgcgtttcagaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaatcacattttgatgtggaaccaaatctgatttgagaaccaagttgattttgatggattttgcaggagaattagccacagaactcaccatcaaaatcatggacac

SEQ ID NO: 2523 - DNA, 682 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacatacattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttat

SEQ ID NO: 2524 - DNA, 738 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacagcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttcgtcattatctagttaaccg

SEQ ID NO: 2525 - DNA, 730 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacattttttttgtcattatcttagttaaccg

SEQ ID NO: 2526 - DNA, 738 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctgggcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaatgtgaaagttataactattaacttttgactaaacttgaaaaaattcacatttttgatgtggaaccaaatctgatttgagaaccaagttgatttttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaagggaatctttatacttcagataaagctgttcttgaacattttttttagtcattatcttagttaaccgagaag

SEQ ID NO: 2527 - DNA, 738 bp, Artificial; identical to SEQ ID NO: 2313
  Glycine max FAD3A mutation created with TALEN pair GmFAD3_T02.1
  misc_feature (683): n is a or c or t or g

SEQ ID NO: 2528 - DNA, 738 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacatgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttcgtcattatctagttaaccg

SEQ ID NO: 2529 - DNA, 776 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacattgctggcgatggccaccacctgctccgggggtcaagccgtgggcctggcacagcaccggcaacagcgcctgcaccgtctcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaataagaaatcacgtttaaatgtgaaagttataactattaacttttgactaaacttgaaaaaaatcacattttgatgtggaaccaaatctgatttgagaaccaagttgattttgatggattttgcaggagaattagccacagaactcaccatcaaaatcatggacacattgagaagggatgaatcctgggttccagtatgtgattaactacttcctctatagttattttttgattcaattaattttatttatttaataagttcaagaaaaaggaatctttatacttcagataaa

SEQ ID NO: 2530 - DNA, 747 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcgatggccaccacctgctccggggtcaagccgtgggcctggcacagcaccggcaacagccgctggaccgtctccagcgcctgcttgccaccattattgctggcgatggccaccttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgacgtgtttggaatcccatttgagaaataagaaatcacgtttaaaatgtgaaagttataactattaacttttgactaaacttgaaaaaaatcacatttttgatgtggaaccaaatctgatttgagaaccaagttgattttgatggattttgcaggagaattagccatcagaactcaccatcaaaatcatggacacattgagaagggatgaatcctgggttccatgtatgtgattaactacttcctctatagttatttttgattcaattaa

SEQ ID NO: 2531 - DNA, 623 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcatcttctcatcgattgaatacagtggccatggaagcttttcagacagcccttttctaaatagcctggtgggacacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagta

SEQ ID NO: 2532 - DNA, 816 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacagcgcctgcttgccgccatcgtggctggcgatggccaccacctgctccggggtcaagccgtgggcctggcacagcaccggcaacagccgctggattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatattttattgcgtgtttggaatcccatttgagaaataagaatcacgtttaaaatgtgaaagttataactattaacttttgactaaacttgaaaaaatcacatttttgatgtggaaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaatttatttattaataagtcaagaaaaaggaatctttatacttcagataaagctgttcttgaaacattttttttcgtcattatcttag

SEQ ID NO: 2533 - DNA, 690 bp, Artificial
  Glycine max FAD3A mutation created with TALEN pair GmFAD3_T02.1
  misc_feature (397): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggatggccagcaataatggtggcaagcaggcgctggagacggtccagcggctgttgccggtgctgtgccaggcccacggcttgaccccggagcaggtggtgcattcctcaattcttgtgccataccatggatggttagttcatcccggcttttttgtttgtcattggaagttcttttattgattcaatttttatagcgtgttcggaaacgcgtttcagtaaaataatgaaatncatcttgaatctgaaagttataacttttagcttcattgtcattgaaagttcttttattaattatatttttattgacgtgtttggaatcccatttgagaaataagaaatcacgttaaaatgtgaaagttataactattaactttgactaaacttgaaaaaaactcacattttgatgtggaaccaaattctgatttgagaacaagttgattttgatggattttgctaggagaattagcccacagaacttcaccattcaaaaattcatggacacattgagaaggatgaatcctggg

SEQ ID NO: 2534 - DNA, 714 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatattttattgcgtgtttggaatcccatttgagaaataagaaatcacgtttaaaaattgtgaaagttataactattaacttttgactaaaacttgaaaaaactcacatttttgatgtggaaccaaatctgattttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttattaataagttcaagaaaaaggaatctttatacttcagataaagctgttcttgaacatttttttagtcattatcttagttaaccgag

SEQ ID NO: 2535 - DNA, 601 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagcattcctcaattcttgtgccatatcatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagtttctttttattaaattatatttttcattgcgtgtttggaatcccatttgagaaataagaaatcacgtttaaaattgtgaaagttataactattaacttttgactaaacttgaaaaaactcacatttttgatgtggaaccaaatctgattttgagaaccaagttgattttgatggattttgcaggagaattagccacagaactcaccatcaaaagtcatggacacattgagaaggatgaatcctgggttccagtatgtgattaactacttcctctatagtta

SEQ ID NO: 2536 - DNA, 652 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgagaagttggcctgtgtccaactgtaacggtggacctctcaactctcccgccaccgtgagcaagtgcattcctcaattcttgtgccataccatggatggttagttcatcccggcttttttgtttgtcattggaagttcttttattgattcaatttttatagcgtgttcggaaacgcgtttcagaaataatgaaatacatcttgaatctgaaagttataacttttagcttcattgtcattgaaagttcttttattaattatatttttattgcgtgtttggaatcccatttgagaataagaaatcacgtttaaaatgtgaaagttataactattaacttttgactaaacttgaaaaaaatcacatttttgatgtggaaccaaaatctgatttgagaaccaagttgattttgatggattttgcaggagaattagccacagaactcaccatcaaaatcatggacacaattgagaagggatg

SEQ ID NO: 2537 - DNA, 737 bp, Artificial; identical to SEQ ID NO: 2054
  Glycine max FAD3A mutation created with TALEN pair GmFAD3_T02.1
  misc_feature (682): n is a or c or t or g

SEQ ID NO: 2538 - DNA, 737 bp, Artificial; identical to SEQ ID NO: 1997
  Glycine max FAD3A mutation created with TALEN pair GmFAD3_T02.1

SEQ ID NO: 2539 - DNA, 740 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggaccttgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacattttttttcgtcattatcttagttaaccg

SEQ ID NO: 2540 - DNA, 643 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacagcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaagtcatggacacattgagaaggatgaatcctgggttccagtatgtgattaactacttcctctatagttatttttcgattcaatt

SEQ ID NO: 2541 - DNA, 736 bp, Artificial; identical to SEQ ID NO: 2122
  Glycine max FAD3A mutation created with TALEN pair GmFAD3_T02.1

SEQ ID NO: 2542 - DNA, 615 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacagcattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaaagttataacttttagcttcattgtcattgaaagttcttttattaatatattttattgcgtgtttggaatcccatttgagaaataagaaatcacgtttaaaatgtgaaagttataactattaacttttgactaaacttgaaaaaactcacattttgatgtggaaccaaattctgatttgagaaccaagttgattttgatggattttgcaggagaattagccacagaactcaccatcaaaagtcatggacacattgagaaggatgaatcctgggttccagtatgtgattaactacttcc

SEQ ID NO: 2543 - DNA, 736 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggactgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttataagttcaagaaaaatggaatctttatacttcagataaagctgttcttgaacattttttttcgtcattatctagttaaccg

SEQ ID NO: 2544 - DNA, 745 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtcttgcattcctcaattcttgtgccataccatggatggttagttcatcccggcttttttcgttttgtcattggaagttcttttattgattcaatttttatagcgttgttcggaaacgcgtttcagaaaataatgaaaatatcatcttgaatctgaaaagttataaacttttagtcttcattgtcattgaaagttacttttattaattaattattttatttgcgtgtttggaatcccatttgagaaaataagaaatcacgtttaaaatgtgaaagttataactattaacttttgactaaacttgaaaaaaatcacattttgatgtggaaccaaatctgatttgagaaccaagttgattttgatggattttgcaggagaattagccacagaaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacatttttttttgtcattatcttagttaaccg

SEQ ID NO: 2545 - DNA, 619 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaaatcatttatgttttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaaatcttgaaaaaagctcactatttttggatgtggaaccaaattctgatttgagaaccaagttgattttgatggattttgcaggagaattagccacagaactcaccatcaaaagtcatggacacattgagaagggatgaatcctgggttccagtatgtgattaactacttcctctatagttatttttcgattcaattaaattttattatttaataagttcaagaaaaatggaatctttatacttcagataaa

SEQ ID NO: 2546 - DNA, 664 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttctctatagtatttttgattcaattaaatttatttatttaataagttcaagaaaaa

SEQ ID NO: 2547 - DNA, 736 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacaagcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttgtcattatcttagttaaccg

SEQ ID NO: 2548 - DNA, 619 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggatgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaactcacatttttgatgtggaaccaaatctgatttgagaaccaagttgattttgatggattttgcaggagaattgatgccacagaactcaccatcaaaagtcatggacacattgagaaggatgaatcctgggttccagtatgtgattaactacttcc

SEQ ID NO: 2549 - DNA, 726 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaagttataacttttagcttcattgtcattgaaagttcttttattaaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaaataagttcaagaaaaaaggaatctttatacttcagataaagctgttcttgaacattttttttgtcattatctta

SEQ ID NO: 2550 - DNA, 738 bp, Artificial
  Glycine max FAD3A mutation created with TALEN pair GmFAD3_T02.1
  misc_feature (683): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttntacttcagataaagctgttcttgaacattttttttcgtcattatctagttaaccg

SEQ ID NO: 2551 - DNA, 644 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacatgcattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaaatctgatttgagaaccaagttgattttgatggattttgcaggagaattagccacagaactcaccatcaaaatcagtggacacattgagaaggatgaatcctgggttccagtatgtgattaactacttcctctatagttatttttgattcaattaaa

SEQ ID NO: 2552 - DNA, 739 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacttgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttcgtcattatctagttaaccg

SEQ ID NO: 2553 - DNA, 735 bp, Artificial
  Glycine max FAD3A mutation created with TALEN pair GmFAD3_T02.1
  misc_feature (680): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttntacttcagataaagctgttcttgaacattttttttcgtcattatctagttaaccg

SEQ ID NO: 2554 - DNA, 731 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagccctttagacaacttatatttgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttcgtcattatctagttaaccga

SEQ ID NO: 2555 - DNA, 736 bp, Artificial; identical to SEQ ID NO: 1687
  Glycine max FAD3A mutation created with TALEN pair GmFAD3_T02.1

SEQ ID NO: 2556 - DNA, 733 bp, Artificial
  Glycine max FAD3A mutation created with TALEN pair GmFAD3_T02.1
  misc_feature (678): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaatttatttatttataagttcaagaaaaatggaatctttntacttcagataaagctgttcttgaacattttttttcgtcattatctagttaaccg

SEQ ID NO: 2557 - DNA, 735 bp, Artificial
  Glycine max FAD3A mutation created with TALEN pair GmFAD3_T02.1
  misc_feature (682): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacaccgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttntacttcagataaagctgttcttgaacatttttttcgtcattatctagttaacc

SEQ ID NO: 2558 - DNA, 639 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggagcattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccatatgtgattaacctaacttcctctatagttatttttgattcaattaaa

SEQ ID NO: 2559 - DNA, 701 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacactgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggatttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttc

SEQ ID NO: 2560 - DNA, 733 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcaagccgtgggcctggcacagcaccggcaacagccgctggaccgtctccagcgcctgcttgccaccatcgtggctggcgatggccaccacctgctggggggtcaagccgtgggcctggcacagcaccggcaacagccgctggaccgtctccagcgcctgcttgccaccgccttgcattcctcaattcttgtgccataccatggatggttagttcatcccggctttttgtttgtcattggaagttcttttattgattcaatttttatagcgtgttcggaaacgcgtttcagaaaaataatgaaatacatcttgaatctgaaagttataacttttagcttcattgtcattgaaagttcttttattaattatatttttattgcgtgtttggaatcccatttgagaaataagaatcacgtttaaaatgtgaaagttataactattaacttttgactaaacttgaaaaaatcacatttttgatgtggaaccaaatctgatttgagaaccaagtttgattttgatggattttgcaggagaatttagccacagaactcaccatcaaaa

SEQ ID NO: 2561 - DNA, 728 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaatttatttatttaataagttcaagaaaaatggaatctttatacttcagataaagctgttcttgaacattttttttcgtcattatc

SEQ ID NO: 2562 - DNA, 667 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaa

SEQ ID NO: 2563 - DNA, 740 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaaacttgaaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaaatctttatacttcagataaagctgttcttgaacattttttttgtcattatctaagttaaccg

SEQ ID NO: 2564 - DNA, 737 bp, Artificial; identical to SEQ ID NO: 1997
  Glycine max FAD3A mutation created with TALEN pair GmFAD3_T02.1

SEQ ID NO: 2565 - DNA, 737 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacttgcattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaacgctcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttcgtcattatctagttaaccg

SEQ ID NO: 2566 - DNA, 716 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaattatttattaataagttcaagaaaaaggaatctttatacttcagataaagctgttcttgaacattttttttcgtca

SEQ ID NO: 2567 - DNA, 883 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatccagcaataatggtggcaagcaggcgctggagacggtccagcggctgttgccggtgctgtgccaggcccacggcttgacccccagcaggtggtggccatcgccgaccctgccgcttaccggatacctgtccgcctttctcttgcattcctcaattcttgtgccataccatggatggttagttcatcccggcttttttgtttgtcattggaagttcttttattgattcaatttttatagcgtgttcggaaacgcgtttcagaaaatatgaaatacatcttgaatctgaaagttataacttttagcttcattgtcattgaaagttcttttattaattatatttttattgcgtgtttgggaatcccatttgagaaataagaaatcacgtttaaaatgtgaaagttataactattaacttttgactaaaactttgaaaaaactcacatttttgatgtggaaccaaatctgatttgagaaccaagttgatttttgatggattttgcaggagaattagccacagaactcaccatcaaaatcatggacacattgagaaggatgaatcctgggttccagtatgtgattaactacttcctctatagttattttttgattcaattaaatttatttatttaataagttcaagaaaaatggatcttttataacttcagataaagctgttcttgaacattttttttcgtcattatcttagttaa

SEQ ID NO: 2568 - DNA, 813 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatccccctggaagctccctcgtgcgctctcctgttccgaccctgccgcttaccggatacctgtccgcctttctcttgcattcctcaattcttgtgccataccatggatggttagttcatcccggcttttttgtttgtcattggaagttctttttattgattcaatttttatagcgtgttcggaaaacgcgtttcagaaaataatgaaatacatcttgaatctgaaagttataacttttagcttcattgtcattgaaagttcttttattaattatattttattgcgtgtttggaatcccatttgagaaataagaaatcacgtttaaaatgtgaaagttataactattacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacatttttttgtcattatcttagttaaccgagaag

SEQ ID NO: 2569 - DNA, 718 bp, Artificial; identical to SEQ ID NO: 1689
  Glycine max FAD3A mutation created with TALEN pair GmFAD3_T02.1

SEQ ID NO: 2570 - DNA, 736 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacactgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggatttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttgtcattatctagttaaccg

SEQ ID NO: 2571 - DNA, 630 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggagcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaaactcaccatcaaaatcatggacacattgagaaggatgaatcctgggttccagtatgtgattaactacttcctctatagttatttttg

SEQ ID NO: 2572 - DNA, 738 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacagcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacatttttttcgtcattatctagttaaccga

SEQ ID NO: 2573 - DNA, 650 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacatacattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttattt

SEQ ID NO: 2574 - DNA, 570 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaaatgtgaaagttataactattaacttttgactaaacttgaaaaaatcacatttttgatgtggaaccaaatctgatttgagaaccaagttgatttgatggattttgcaggagaattagccacagaactcaccatcaaaatcatggacacattgag

SEQ ID NO: 2575 - DNA, 759 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcgcctgcttgccaccattattgctggcgatggccaccacctgctggggggtcaagccgtgggcctggcacagcaccggcaacagccgctggaccgtctccagcgcctgcttgccaccgccattgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatattttattgcgtgtttggaatcccatttgagaaataagaaatcacgtttaaaatgtgaaagttataactattaacttttgactaaacttgaaaaaactcacatttttgatgtggaaccaaatctgatttgagaaccaagttgatttttgatggattttgcaggagaattagccacagaactcaccatcaaaatcatggacacattgagaaggatgaatcctgggttccagtatgtgattaactacttcctctatagttattttttgatt

SEQ ID NO: 2576 - DNA, 467 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcaca

SEQ ID NO: 2577 - DNA, 736 bp, Artificial
  Glycine max FAD3A mutation created with TALEN pair GmFAD3_T02.1
  misc_feature (251): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacattcctcaattcttgtgccataccatggatggttagttcatcccggcttttttgtttgtcattggaagttctttttattgnttcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacatttttgatgtggaaccaaatctgatttgagaaccaagttgattttgatggattttgcaggaggattagccacagaactcaccatcaaaatcatggacacattgagaaggatgaatcctgggttccagtatgtgattaactacttcctctatagttatttttgattcaattaaatttattttatttaataagttcaagaaaaaggaatctttatacttcagataaagctgttcttgaacattttttttcgtcattatcttagttaacc

SEQ ID NO: 2578 - DNA, 767 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcgatggccaccacctgctccggggtcaagccgtgggcctggcacagcaccggcaacagccgctggaccgtctccagcgcctgcttgccaccattattgctggcgatggccaccttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaagtgtgaaagttataactattaacttttgactaaacttgaaaaaaactcacatttttcgatgtggaaccaaaattctgatttgagaaccaagttgattttgatggatttttggcagggagaattagcccacagaactcaccatcaaaattcatggacacattgagaagggatgaatcctgggttccagtatgtgattaacctacttcctctatagttattttttggattcaatttaattttattta

SEQ ID NO: 2579 - DNA, 613 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatattttttattgcgtgtttggaatcccatttgagaaataagaaatcacgtttaaaatgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaacctactt

SEQ ID NO: 2580 - DNA, 567 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacatgcattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaactttttgactaaaacttgaaaaaaactcacatttttgatgtggaaccaaatctgatttgagaaccaagttgattttgatggattttgcaggagaattagccacagaactcaccatcaaaatcat

SEQ ID NO: 2581 - DNA, 709 bp, Artificial
  Glycine max FAD3A mutation created with TALEN pair GmFAD3_T02.1
  misc_feature (471): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggactcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaatgtgaaagttataactattaacttttgactaaacttgaaaaaatcacatttttgntgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaaggaatcttatacttcagataaagctgttcttgaacatttttttt

SEQ ID NO: 2582 - DNA, 578 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtggggcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccattttgagaaataagaaatcacgtttaaaatgtgaaagttataactattaacttttgactaaacttgaaaaaattcacatttttgatgtggaaccaaatctgatttgagaaccaagttgatttgatggaattttgcaggagaatttagccacagaactcaccatcaaaatcatggacacattgagaagg

SEQ ID NO: 2583 - DNA, 449 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacatctccagcgcctgcttgccaccattattgctggcgatggccaccacctgctggggggttcaagccgtgggcctggcacagcaccggcaacagcgtcttgcattcctcaattcttgtgccataccatggatggttagttcatcccggcttttttgtttgtcattggaagttcttttattgattcaatttttgatagcgtgttcggaaatcgcgtttcagaaaagtaatgaaatacatcttgaatctgaaagttataacttttagcttcattgtcattgaaa

SEQ ID NO: 2584 - DNA, 696 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacaacttgtgccataccatggatggttagttcatcccggcttttttgtttgtcattggaagttcttttattgattcaatttttatagcgtgttcggaaacgcgtttcagaaataatgaaatacatcttgaatctgaaagttataacttttagcttcattgtcattgaaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaaggaatctttatacttcagataaagctgttcttgaacattttttttgtcattatcttagttaaccgag

SEQ ID NO: 2585 - DNA, 744 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacaccggtgctgtgccaggcccacggcttgacccctcagcaggtggtggccatcgccagcaatggcggcggcaggccggcgctggagagcattgttgcccagttatctcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatattttattgcgtgttggaatcccatttgagaaataagaaatcacgtttaaaatgtgaaagttataactattaacttttgactaaacttgaaaaaatcacatttttgatgtggaaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaa

SEQ ID NO: 2586 - DNA, 734 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggatgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaaggaatctttatacttcagataaagctgttcttgaacattttttttgtcattatcttagttaacc

SEQ ID NO: 2587 - DNA, 733 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttcgtcattatctagttaacc

SEQ ID NO: 2588 - DNA, 733 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctgatggccctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaaaggaatctttatacttcagataaagctgattcttgaacatttttttgtcattatcttagttaaccgagaag

SEQ ID NO: 2589 - DNA, 737 bp, Artificial; identical to SEQ ID NO: 2371
  Glycine max FAD3A mutation created with TALEN pair GmFAD3_T02.1

SEQ ID NO: 2590 - DNA, 734 bp, Artificial; identical to SEQ ID NO: 1691
  Glycine max FAD3A mutation created with TALEN pair GmFAD3_T02.1

SEQ ID NO: 2591 - DNA, 737 bp, Artificial; identical to SEQ ID NO: 1996
  Glycine max FAD3A mutation created with TALEN pair GmFAD3_T02.1

SEQ ID NO: 2592 - DNA, 737 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacttgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagtatttttgattcaattaaatttatttatttaataagttcaagaaaaatggaatctttatacttcagataaagctgttcttgaacattttttttcgtcattatctagttaaccg

SEQ ID NO: 2593 - DNA, 698 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggttcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaatgtgaaagttataactattaacttttgactaaacttgaaaaaattcacatttttgatgttggaaccaaatctgatttgagaaccaagttgattttgatggattttgcaggagaatttagccacagaactcaccatcaaaatcatggacacattgagaaggatgaatcctgggttccagtatgtgattaactacttcctctatagttatttttgattcaattaaatttatttatttaataagttcaagaaaaaagggaatctttatacttcagataaagctgtt

SEQ ID NO: 2594 - DNA, 401 bp, Artificial
  Glycine max FAD3A mutation created with TALEN pair GmFAD3_T02.1
  misc_feature (359): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacaaaaatcgacgctcaagtcagaggtggcgaaacccgacaggactataaagataccaggcgtttccccctggaagctccctcgtgcgctctcctgttccgaccctgccgcttaccggatacctgtcctgccttgcattcctcaattcttgtgccataccatggatggttagttcatcccggctttttgttgncattggaagtcttttattgatcaatttttatagcgtgttcgg

SEQ ID NO: 2595 - DNA, 736 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttcgtcattatcttagttaaccg

SEQ ID NO: 2596 - DNA, 475 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaaattcttgtgccataccatggatggttagttcatcccggcttttttgtttgtcattggaagttcttttattgatttcaattttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaatgttataactattaacttttgactaaacttgaaaaaactcaca

SEQ ID NO: 2597 - DNA, 808 bp, Artificial
  Glycine max FAD3A mutation created with TALEN pair GmFAD3_T02.1
  misc_feature (542): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacttgccggtgctgtgccaggcccacggcttgaccccggagcaggtggtggccatcgccagcaatggcggtggcaagcaggcgctggagacggtccagcggctgttgccggtgctgtgccaggcccacggcttgaccccggagcaggtggtggccatcgccagcaattcctcaattcttgtgccataccatggatggttagttcatcccggctttttttggtttgtcattggaagttcttttattgattcaatttttatagcgtgttcggaaacgcgtttcagaaaattaatgaaatacatcttgaatctgaaagttataacttttagcttcattgtcattgaaagttcttttattaattatattttattgcgngtttggaatcccatttgagaaataagaaatcacgtttaaaatgtgaaatgttataactattaactttgactaaacttgaaaaatcacatttttgatgtggaaccaaatctgatttgagaaccaagttgattttgatggattttgcaggagaattagccacagaactcaccattcaaaatcatggacacattgagaatggatgaatcctgggttccagtatgtgattaactactttcctctatagttatttttgatcaattaaattt

SEQ ID NO: 2598 - DNA, 727 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacagcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttgtcattatct

SEQ ID NO: 2599 - DNA, 644 bp, Artificial
  Glycine max FAD3A mutation created with TALEN pair GmFAD3_T02.1
  misc_feature (211): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacagcattcctcaattcttgtgccataccatggatggtagttcancccggcttttttgttttgtcattggaagttctttttatgattcaatttttatagcgttgttcggaaacgcgtttcgaaaataatgaaaatacatcttgaatctgaaagttataacttttagtcttcattgtcattgaaagttcttttattaattatatttttatttgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacatgaacttcaccatcaaaatcatggacacattgagaaggatgaatcctgggttccagtatgtgattaactacttcctctatagttatttttgattcaattaaa

SEQ ID NO: 2600 - DNA, 422 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatccccggctttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttatttgcgtgtttgggaatcccatttgagaaataagaaatcacgttt

SEQ ID NO: 2601 - DNA, 736 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggttcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaatgtgaaagttataactattaacttttgactaaacttgaaaaaattcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttcgattcaattaaatttatttatttaataagttcaagaaaaaagggaatctttatacttcagataaagctgttcttgaacattttttttagtcattatcttagttaaccgag

SEQ ID NO: 2602 - DNA, 735 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacgcattcctcaattcttgtgccataccatggatggttagttcatcccggcttttttgtttgtcattggaagttctttttattgattcaatttttatagcgtgttcggaaacgcgtttcaggaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaactctttatacttcagataaagctgttctgaacattttttttcgtcattatcttagtaaccg

SEQ ID NO: 2603 - DNA, 652 bp, Artificial
  Glycine max FAD3A mutation created with TALEN pair GmFAD3_T02.1
  misc_feature (252): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacatattcctcaattcttgtgccataccatggatggttagttcatcccggctttttttgtttgtcattggaagttctttttattgnttcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacatttttgatgtggaaccaaatctgatttgagaaccaagttgattttgatggattttcgcaggagaattagccacagaactcaccatcaaaagtcatggacacattgagaaggatgaatcctgggttccagtatgtgattaactacttcctctatagttatttttcgattcaattaatttattt

SEQ ID NO: 2604 - DNA, 631 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagccttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaataagaaatcacgtttaaaatgtgaagttataactattaacttttgactaaacttgaaaaaatcacatttttgatgtggaaccaaatctgatttgagaaccaatgttgattttgatggattttgcaggagaattagccacagaactcaccatcaaaatcatggacacattgagaaggatgaatcctgggttccagtatgtgattaactacttcctctatagttatttttcgattcaatt

SEQ ID NO: 2605 - DNA, 728 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacattttttttgtcattatcttagttaacc

SEQ ID NO: 2606 - DNA, 724 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacatctccagcgcctgcttgccaccattattgctggcgatggccaccacctgctggggggtcaagccgtgggcctggcacagcaccggcaacagcgtcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatattttattgcgtgttggaatcccatttgagaaataagaatcacgtttaaaatgtgaaagttataactattaacttttgactaaacttgaaaaaagtcacatttttgatgtggaaaccaaatctgatttgagaaccaagttgattttgatggattttgcaggagaattagccacagaactcaccatcaaaatcatggacacattgagaaggatgaatcctgggttccagtatgtgattaactacttcctctatagttattttt

SEQ ID NO: 2607 - DNA, 736 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggagcattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaacctacttcctctatagttatttttgattcaattaaatttatttatttaataagttcaagaaaaaggaatctttatacttcagataaagctgttcttgaacattttttttcgtcattatcttagttaaccg

SEQ ID NO: 2608 - DNA, 749 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacaccctggggtgcctaatgagtgagctaactcacattaattgcgttgcgctcactgcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttgtcattatctagttaaccgagaa

SEQ ID NO: 2609 - DNA, 667 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacagctgtctccattcattgtgcatcatcacgtggatgtgtgtcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttttgattcaattaaatttatttatttaataagttcaag

SEQ ID NO: 2610 - DNA, 817 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacagcgcctgcttgccgccatcgtggctggcgatggccaccacctgctccggggtcaagccgtgggcctggcacagcaccggcaacagccgctggattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgttggaatcccatttgagaaatagaaatcacgtttaaaatgtgaaagttataactattaactttgactaaacttgaaaaaatcacatttttgatgtggaaccaaatctgatttgagaaccaagttgattttgatggattttgcaggagaattagccacagaactcaccatcaaaatcatggacacattgagaagggatgaatcctgggttccagtatgtgattaactacttcctctatagttattttttggattcaattaatttatttatttaataagttcaagaaaaacggaatctttatacttcagattaaagctgttcttgaaacattttttttcgtcattatc

SEQ ID NO: 2611 - DNA, 734 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacagcattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaatttatttatttaataagttcaagaaaaatggaatctttatacttcagataaagctgttcttgaacattttttttcgtcattatctagttaacc

SEQ ID NO: 2612 - DNA, 550 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaaattatatttttattgcgtgtttggaatcccatttgagaaattaagaaatcacgtttaaaattgtgaaagttataactattaacttttgactaaacttgaaaaaactcacatttttggatgtggaacccaaaatctgattttgagaaccaagttgattttgatggattttgcaggagaattagccacagaactcaccatcaaaa

SEQ ID NO: 2613 - DNA, 731 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacagcattcctcaattcttgtgccataccatggatggttagttcatcccggcttttttgttttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaatttatttatttaataagttcaagaaaaaggaatctttatacttcagataaagctgttcttgaacatttttttttcgtcattatcttag

SEQ ID NO: 2614 - DNA, 685 bp, Artificial
  Glycine max FAD3A mutation created with TALEN pair GmFAD3_T02.1
cactgctttgttatgcctacctcatttcatttggctttagacaacttaaattgttgactttattatgttttttgcttatatggtaaagtgattcattcttcacattgaattgaacagtggccatggaagcttttcagacagcccttttctaaacatcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaaattgtgaaagttataactattaacttttgactaaacttgaaaaaatcacatttttgatgtggaaccaaatctgattttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaaggaatctttatacttcagataaagctgtt

SEQ ID NO: 2615 - DNA, 724 bp, Artificial
  Glycine max FAD3A mutation created with TALEN pair GmFAD3_T02.1
cactgctttgttatgcctacctcatttcatttggctttagacaacttaaatttgagtatctttattatgttttttgcttatatggtaaagtgattcattcttcacattgaattgaacagtggccatggaagcttttcagacagcccttttctaaatagcctggtgggacacttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgattgagaaccaagttgattttgatggatttgcaggagaattagccacagaactcaccatcaaaatcatggacacattgagaaggatgaatcctgggttccagtatgtgattaactacttcctctatagttatttttgattcaattaaatttatttatttaataagttcaagaaaaaaggaatctttatacttcagataaagctgttcttgaacatttttttgtcattatc

SEQ ID NO: 2616 - DNA, 674 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggatgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattatgccacagaactcaccatcaaaatcatggacacattgagaaggatgaatcctgggttccagtatgtgattaactacttcctctatagttatttttgattcaattaaatttatttatttaataagttcaagaaaaaggaa

SEQ ID NO: 2617 - DNA, 734 bp, Artificial
  Glycine max FAD3A mutation created with TALEN pair GmFAD3_T02.1
cactgctttgttatgcctacctcatttcatttgactttagacaacttaaatttgagatctttattatgttttttgcttatatggtaaagtgattcattcttcacattgaattgaacagtggccatggaagcttttcagacagcccttttctaaatagcctggtgggacaccattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttcgtcattatctagttaacc

SEQ ID NO: 2618 - DNA, 736 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaaggaatctttatacttcagataaagctgttcttgaacattttttttcgtcattatcttagttaaccg

SEQ ID NO: 2619 - DNA, 655 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacagcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttattt

SEQ ID NO: 2620 - DNA, 685 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagctcctcaattcttgtgccataccatggatggttagttcatcccggcttttttgtttgtcattggaagttctttttattgattcaatttttatagcgtgttcggaaacgcgtttcagaaaataatgaaatacatcttgaatctgaaagttataacttttagcttcattgtcattgaaaagttcttttattaattatatttttaattgcgtgtttggaatcccatttgagaaatagaaatcacgtttaaaattgtgaaagttataactattaacttttgactaaacttgaaaaaatcacattttgatgtggaaccaaatctgatttgagaaccaagttgattttgatggatttttgcaggagaattagccacagaactcaccattcaaaaatcattggacacattgagaaggatgaattcctgggttccagtatgtgattaactacttcctctatagttattttgattcaattaaatttattattaataagttcaagaaaaaggaatctttatacttcagataaagctgttcttgaacatttttttgtcttatctta

SEQ ID NO: 2621 - DNA, 736 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacacattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttattttatttaataagttcaagaaaaaggaatctttatacttcagataaagctgttcttgaacattttttttcgtcattatcttagttaacc

SEQ ID NO: 2622 - DNA, 738 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtggggacacagctgtcctccattcattgttgcatcacacgtggatgtgtgtcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttgtcattatctaagttaacc

SEQ ID NO: 2623 - DNA, 716 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacactgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtctggaatcccattgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacatttttttt

SEQ ID NO: 2624 - DNA, 741 bp, Artificial
  Glycine max FAD3A mutation created with TALEN pair GmFAD3_T02.1
  misc_feature (474); (485): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataaacttttagtcttcattgtcattgaaagttacttttatttaattattattttatttgcgtgtttggaatcccatttgagaaataagaaatcacgtttaaaatgtgaaagttataactattaacttttgactaaaacttgaaaaaaactcncattttgatgnggaaccaaatctgatttgagaaccaagttgattttgatggattttgcaggagaattagccacagaactcaccatcaaaagtcatgggacacattgagaaggatgaatcctgggttccagtatgtgattaactacttcctctatagttatttttgattcaattaaatttatttatttaataagttcaagaaaaatggaatctttatacttcagataaagctgttcttgaacattttttttcgtcattatctagttaa

SEQ ID NO: 2625 - DNA, 737 bp, Artificial
  Glycine max FAD3A mutation created with TALEN pair GmFAD3_T02.1
  misc_feature (682): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacacattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttntacttcagataaagctgttcttgaacattttttttcgtcattatctagttaaccg

SEQ ID NO: 2626 - DNA, 644 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaa

SEQ ID NO: 2627 - DNA, 737 bp, Artificial
  Glycine max FAD3A mutation created with TALEN pair GmFAD3_T02.1
  misc_feature (682): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacttgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttntacttcagataaagctgttcttgaacattttttttcgtcattatctagttaaccg

SEQ ID NO: 2628 - DNA, 559 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcgctggagacggtccagcggctgttgccggtgctgtgccaggcccacggcttgaccccggagcaggtggtggccatcgccagccacgatggcggcaaacagccgctggaccattcctcaaattcttgtgccataccatggatggttagttcatcccggcttttttgtttgtcattggaagttcttttattgattcaatttttatagcgtgttcggaaaacgcgtttcagaaaaataatgaaatacatcttgaaatctgaaaagttataaacttttagcttcattgtcattgaaagttctttattaaattatattttattgcgtgtttggaatcccatttgagaaaataagaaaatcacgtttaaaaatgtgaaaagttataaactatt

SEQ ID NO: 2629 - DNA, 747 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtggggtggtggccatcgccagcaatattggtggaactgaaaatggagtgcacatcacaaagattgaatcctcctcaattcttgtgccataccatggatggttagttcatcccggcttttttgtttgtcattggaagttcttttattgattcaatttttatagcgtgttcggaaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttcgcaggagaattagccacagaactcaccatcaaaatcatgggacacattgagaaggatgaatcctgggttccagtatgtgattaactacttcctctatagttatttttgattcaattaaatttatttatttataagttcaagaaaaagggaatctttatacttcag

SEQ ID NO: 2630 - DNA, 734 bp, Artificial; identical to SEQ ID NO: 2208
  Glycine max FAD3A mutation created with TALEN pair GmFAD3_T02.1
  misc_feature (679): n is a or c or t or g

SEQ ID NO: 2631 - DNA, 775 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtggctggcgatggccaccacctgctggggggtcaagccgtgggcctggcacagcaccggcaacagccgctggaccgtctccagcgcctgcttattcctcaattcttgtgccataccatggatggttagttcatcccggctttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaactcacatttttgatgtggaaccaaaattctgatttgagaaccaagttgattttgatggattttggcaggagaattagcccacagaactcaccatcaaaatcatggacacattgagaagggatgaatcctgggttccagtatgtgattaactacttcctctatagttattttttggattcaatttaaattttattttattaataagttcaagaaaaacggaatctttatac

SEQ ID NO: 2632 - DNA, 738 bp, Artificial
  Glycine max FAD3A mutation created with TALEN pair GmFAD3_T02.1
  misc_feature (684): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacttgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaacgctcaccatcaaaatcatggacacattgagaaggatgaatcctgggttccagtatgtgattaactacttcctctatagttatttttgattcaattaaatttatttatttaataagttcaagaaaaatggaatctttntacttcagataaagctgttcttgaacattttttttcgtcattatctagttaacc

SEQ ID NO: 2633 - DNA, 652 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaagtcatggacacattgagaaggatgaatcctgggttccagtatgtgattaactacttcctctatagttatttttgattcaattaaatttattt

SEQ ID NO: 2634 - DNA, 668 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggggggtcaagccgtgggcctggcacagcaccggcaacagccgctggaccgtctccagcgccttgcattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaatgtgaaagttataactattaacttttgactaaacttgaaaaaagttcacatttttgatgttggaaccaaatctgatttgagaaccagttgatttgatggattttgcaggagaattagccacatgaactcaccatcaaagtcatggacacattgagaaggatgaatcctgggttccagtatgtgattaactactt

SEQ ID NO: 2635 - DNA, 634 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacattggcccacggcttgaccccggagcaggtggtggccatcgccagccacgatggcggcaagcaggcgctggagacggtccagcggctgttgccggtgctgtgccaggcccattcctcaattcttgtgccataccatggatggttagttcatcccggctttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgttggaatcccatttgagaaataagaaatcacgtttaaatgtgaaagttataactattaactttgactaaacttgaaaaatcacatttttgtgtggaaccaaatctgatttgagaaccaagttgattttgatggattttgcaggagaatt

SEQ ID NO: 2636 - DNA, 744 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttcatcattacttagttaaccgagtaa

SEQ ID NO: 2637 - DNA, 726 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacagtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgcattcctcaattcttgtgccataccatggatggttagttcatcccggcttttttgttgtcattggaagttcttttattgattcaatttttatagcgtgttcggaaacgcgtttcagaaaataatgaaatacatcttgaatctgaaagttataacttttagcttcattgtcattgaaagttcttttattaattatattttattgcgtgtttggaatcccatttgagaaataagaaatcacgtttaaaatgtgaaagttataactattaactttgactaaaacttgaaaaaatcacatttttgatgtggaaccaaatctgatttgagaaaccaagttgatttttgatggattttgcaggagaattagccacagaactcaccatcaaaatcatggacacattgagaaggatgaa

SEQ ID NO: 2638 - DNA, 732 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtggttcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaatgtgaaagttataactattaacttttgactaaacttgaaaaaattcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaagggaatctttatacttcagataaagctgttcttgaacatttttttagtcattatcttagttaaccga

SEQ ID NO: 2639 - DNA, 623 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaattgtgaaagttataactattaacttttgactaaacttgaaaaaatcacatttttgatgtggaaccaaatctgatttgagaaccaagttgatttgatggattttgcaggagaattagccacagaactcaccatcaaaatcatggacacattgagaaggatgaatcctgggttccagtatgtgattaactacttcctctatagttatttttgatcaattaaattta

SEQ ID NO: 2640 - DNA, 832 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcagcaccggcaacagccgctggaccgtctccagcgcctgcttgccaccattattgctggcgatggccaccacctgctggggggtcaagccgtgggcctggttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgttggaatcccatttgagaaatagaaatcacgtttaaatgtgaaagttataactattaactttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaatttatttattataagttcaagaaaaaggaatctttatactttcagataaagctgttcttgaaacattttttttgtcattatcttagttaacc

SEQ ID NO: 2641 - DNA, 538 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaaattatatttttcattgcgtgtttggaatcccatttgagaaataagaaatcacgtttaaaattgtgaaagttataactattaacttttgactaaatcttgaaaaaactcacattttgatgtggaaccaaatctgatttgagaaccaagttgattttgatggattttgcaggagaattagccacagaactcaccatc

SEQ ID NO: 2642 - DNA, 633 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaaattgtgaaagttataactattaacttttgactaaacttgaaaaaactcacatttttgatgtggaaccaaatctgatttgagaaccaagttgatttgatggattttgcaggagaattagccacagaactcaccatcaaaagtcatggacacattgagaaggatgaatcctgggttccagtatgtgattaactacttcctctatagttatttttgattcaattaaattta

SEQ ID NO: 2643 - DNA, 732 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacaaatcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacatttttttgtcattatcttagttaaccg

SEQ ID NO: 2644 - DNA, 693 bp, Artificial
  Glycine max FAD3A mutation created with TALEN pair GmFAD3_T02.1
  misc_feature (679): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtggcttgcattcctcaattcttgtgccataccatggatggttagttcatcccggcttttttgttttgtcattggaagttcttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagtttgatttttgatggattttgcaggagaattagccacagaactcaccatcaaaatcatggacacattgagaaggatgaatcctgggttccagtatgtgattaactacttcctctatagttatttttgattcaattaatttattttatttaataagtttcaagaaaaaaggaanctttatacttcaga

SEQ ID NO: 2645 - DNA, 735 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacatgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttgtcattatctagttaaccg

SEQ ID NO: 2646 - DNA, 734 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctgggcattcctcaattcttgtgccataccatggatggttagttcatcccggctttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaataagaaatcacgtttaaaatgtgaaagttataactattaacttttgactaaacttgaaaaaattcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttcgattcaattaaatttatttatttaataagttcaagaaaaaagggaatctttatacttcagataaagctgttcttgaacatttttttagtcattatcttagttaaccgag

SEQ ID NO: 2647 - DNA, 738 bp, Artificial
  Glycine max FAD3A mutation created with TALEN pair GmFAD3_T02.1
  misc_feature (683): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttntacttcagataaagctgttcttgaacattttttttcgtcattatctagttaaccg

SEQ ID NO: 2648 - DNA, 427 bp, Artificial
  Glycine max FAD3A mutation created with TALEN pair GmFAD3_T02.1
  misc_feature (371): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacattattaacaaaagttctagagagattttggatgaaagattgttaaccaagtgttgctcccattgtgaaaggtgataggtttaatttgaaccaatgtccaaagaatgactttgagagggaacaaatgaaaaatcattccttgcattcctcaatttcttgtgccataccatggatggttagttcatcccggctttttgttgncattggaagttcttttattgatcaatttttatagcgtgttcggaaacgcgtttcag

SEQ ID NO: 2649 - DNA, 707 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggttcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaatgtgaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaagggaatctttatacttcagataaagctgttcttgaacatttttt

SEQ ID NO: 2650 - DNA, 605 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcccttttcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaattgtgaaagttataactattaacttttgactaaatcttgaaaaaactcacattttgatgtggaaccaaatctgatttgagaaccaagttgattttgatggattttgcaggagaattagccacagaactcacattcaaaatcatggacacattgagaaggatgaatcctgggttccagtatgtgattaatcatactt

SEQ ID NO: 2651 - DNA, 650 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatgcgtattgggcgctcttccgcttcctcgctccggggtaatatgcgtattggccatcaccggcttttttgtttgtcattggaagttcttttattgattcaatttttatagcgtgttcggaaaacgcgtttcagaaaataatgaaatacatcttgaatctgaaaagttataacttttagcttcattgtcattgaaagttcttttattaattatatttttattgcgtgtttggaatcccatttgagaaataagaaatcacgtttaaatgtgaaagttataactattaacttttgactaaacttgaaaaaattcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattc

SEQ ID NO: 2652 - DNA, 645 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacaatcgccaccaatattggtggcaagcaggcgatggccaccacctgctggggggtcaagccgtgggcctggcacagcaccggcaacagccgctggaccgtctccagcgcctgcttgccaccgccattgcattcctcaattcttgtgccataccatggatggttagttcatcccggctttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgttggaatcccatttgagaaataagaatcacgtttaaaatgtgaaagttataactattaactttgactaaacttgaaaaaagtcacatttttgatgtggaaccaaatctgatttgagaaccaagttgattttgatggattttg

SEQ ID NO: 2653 - DNA, 737 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacatgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacatttttttcgtcattatctagttaaccg

SEQ ID NO: 2654 - DNA, 609 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagccctttttctaaatagcctggtgggacacttgcattcctcaattcttgtgccataccatggatggttagttcatcccggcttttttgtttgtcattggaagttcttttattgattcaatttttatagctgttcggaaacgcgtttcagaaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaa

SEQ ID NO: 2655 - DNA, 759 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacactggtcggccacgggtttacacacgcgcacatcgttgcgttaagccaacacccggcagcgttttgcattcctcaattcttgtgccataccatggatggttagttcatcccggcttttttgtttgtcattggaagttcttttattgattcaatttttaatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaag

SEQ ID NO: 2656 - DNA, 700 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaaataagaaatcacgtttaaaatgtgaaagttataactattaactttgactaaacttgaaaaaatcacattttgatgtggaaccaaatctgatttgagaaccaagttgattttgatggattttgcaggagaattagccacagaactcaccatcaaaaatcatggacacattgagaaggatgaatcctgggttccagtatgtgattaactacttcctctatagttatttttgattcaattaaaatttatttatttaataagttcaagaaaaaaggaatctttatacttcagataaagctgttcttgaacattttttttgtcattatcttagttaaccgag

SEQ ID NO: 2657 - DNA, 719 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaattctttatacttcagataaagctgttcttgaacatttttttt

SEQ ID NO: 2658 - DNA, 752 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatgctggcgatggccaccacctgctggggggtcaagccgtgggcctggcacagcaccggcaacagcgcctgcaccgtctccagcgcctgcttttcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatattttattgcgtgttggaatcccatttgagaaataagaatcacgtttaaaatgtgaagttataactattaactttagactaaacttgaaaaatcacattttgatgtggaaccaaatctgatttgagaaccaagttgaattttgatggattttgcaggagaattagccacagaactcaccatcaaaatcatggacacattgagaaggatgaatcctgggttccagtatgtgattaactacttcctctatagttatttttgattcaattaatttatttatttaataagttcaagaaaaa

SEQ ID NO: 2659 - DNA, 717 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgttgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttattttatttaataagttcaagaaaaaaggaatctttatacttcagataaagctgttcttgaacattttttttgtca

SEQ ID NO: 2660 - DNA, 736 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggaccattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacattttttttcgtcattatcttagttaaccg

SEQ ID NO: 2661 - DNA, 777 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacagcgcctgcttgccgccatcgtggctggcgatggccaccacctgctccggggtcaagccgtgggcctggcacagcaccggcaacagccgctggattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttcttttattaattatattttattgcgtgttggaatcccatttgagaaataagaatcacgtttaaaatgtgaaagttataactattaacttttgactaaacttgaaaaaagtcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttttggattcaattaatttatttattatagttcaagaaaaacggaatctttatacttcaga

SEQ ID NO: 2662 - DNA, 483 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacagcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaa

SEQ ID NO: 2663 - DNA, 683 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctgggcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaatgtgaaagttataactattaacttttgactaaaacttgaaaaaatcacatttttgatgttggaaccaaatctgaatttgagaaccaagttgattttgatggaattttgcaggagaatttagccacagaactcaccatcaaaatcatggacacattgagaaggatgaatcctgggttccaagtatgtgattaactacttcctctatagttatttttgattcaattaaatttatttatttaataagttcaagaaaaaaaggaatctttata

SEQ ID NO: 2664 - DNA, 738 bp, Artificial; identical to SEQ ID NO: 2366
  Glycine max FAD3A mutation created with TALEN pair GmFAD3_T02.1

SEQ ID NO: 2665 - DNA, 602 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacattggcccacggcttgaccccggagcaggtggtggccatcgccagccacgatggcggcaagcaggcgctggagacggtccagcggctgttgccggtgctgtgccaggcccattcctcaattcttgtgccataccatggatggtagttcatcccggctttttgtttgcattggaagttcttttattgattcaatttttatagcgtgttcggaaacgcgtttcagaaataatgaaatacatcttgaatctgaaagttataacttttagcttcatttgtcattgaaaagttcttttattaattattattttattgcgtgttggaatcccatttgagaataagaaatcacgtttaaattgtgaaagttatactattaactttgactaaacttgaaaaagtcacatttttgatgtggaaccaaatctgatttgagaacc

SEQ ID NO: 2666 - DNA, 616 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaatggcattcctcaatttcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatatttttattgcgtgtttggaatcccatttgagaataagaaatcacgtttaaaattgtgaaagttataactattaacttttgactaaacttgaaaaaactcacatttttgatgtggaaccaaatctgatttgagaaccaagttgattttgatggattttcgcaggagaattagccacagactcacatcaaatcatggacacattgagaaggattgaatcctgggttccagtatgtgattaactacttcctctatagttattttt

SEQ ID NO: 2667 - DNA, 573 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacactgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaaatcacgtttaaaaatgtgaaagttataactattaacttttgactaaaacttgaaaaaaatcacattttgatgtggaaccaaatctgatttgagaaaccaagttgattttgatggattttgcaggagaattagccacagaaactcaccatcaaaatcatggac

SEQ ID NO: 2668 - DNA, 612 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggagcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcc

SEQ ID NO: 2669 - DNA, 738 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttcgtcattatcttagttaaccg

SEQ ID NO: 2670 - DNA, 736 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacaacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttataagttcaagaaaaatggaatctttatacttcagataaagctgttcttgaacattttttttcgtcattatctagttaaccg

SEQ ID NO: 2671 - DNA, 742 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacaccttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgatttcaattaaatttattttatttaataagttcaagaaaaatggaaatctttatacttcagataaagctgttcttgaacattttttttgtcattatctagttaaccg

SEQ ID NO: 2672 - DNA, 424 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacactattgctggcgatggccaccacctgctccggggtcaagccgtgggcctggcacagcaccggcaacagcgcctggaccgtctccagcgcctgcttgccaccaaactcaattcttgtgccataccatggatggttagttcatcccggctttttggtttgtcattggaagttcttttattgattcaatttttatagcgtgttcggaaacgcgtttcagaaaagtaatgaaatacatcttgaatctgaaagttataac

SEQ ID NO: 2673 - DNA, 721 bp, Artificial
  Glycine max FAD3A mutation created with TALEN pair GmFAD3_T02.1
  misc_feature (676): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggatgcattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttataagttcaagaaaatggaatctttntacttcagataaagctgttcttgaacattttttttgtcattatct

SEQ ID NO: 2674 - DNA, 736 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggatgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgatttcaattaaatttattttatttaataagttcaagaaaaaggaagatctttatacttcagataaagctgttcttgaacatttttttttgtcattatctagttaacc

SEQ ID NO: 2675 - DNA, 684 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaaatcatggacacattgagaaggatgaatcctgggttccagtatgtgattaactacttcctctatagttattttgattcaattaaaatttatttatttaataagttcaagaaaaaaggaaatctttatacttcagataaagctgttcttgaacattttttttgtcattatc

SEQ ID NO: 2676 - DNA, 727 bp, Artificial
  Glycine max FAD3A mutation created with TALEN pair GmFAD3_T02.1
  misc_feature (679): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttataagttcaagaaaaatggaatctttntacttcagataaagctgttcttgaacattttttttcgtcattatctag

SEQ ID NO: 2677 - DNA, 736 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacattttttttcgtcattatcttagttaaccg

SEQ ID NO: 2678 - DNA, 648 bp, Artificial
  Glycine max FAD3A mutation created with TALEN pair GmFAD3_T02.1
  misc_feature (369): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacttgcattcctcaattcttgtgccataccatggatggttagttcatcccggcttttttgtttgtcattggaagttcttttatgattcaatttttatagcgtgttcggaaacgcgtttcagaaaaataatgaaatacatcttgaatctgaaaagttataacttttagcttcattgtcattgaaagttcttttattaattanatttttattgcgtgtttggaatcccatttgagaaataagaaatcacgtttaaaattgtgaaagttataactattaacttttgactaaacttgaaaaaactcacattttgatgtggaaccaaatctgatttgagaaccaagttgattttgatggattttgcaggagaattagccacagaactcaccatcaaaagtcatggacacattgagaaggatgaatcctgggttccagtatgtgattaacctacttcctctatagttatttttcgattcaattaaa

SEQ ID NO: 2679 - DNA, 822 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacaggtggtggccatcgccagcaatattggtggcaagcaggcgctggagacggtgcaggcgctgttgccggtgctgtgccaggcccacggcttgaccccggagcaggtggtggccatcgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagtataactattaacttttgactaaaatcttgaaaaaaactcacatttttgatgtgggaaccaaaattctgatttgagaaccaagttgattttgatggattttgcaggagaattagccacagaactcaccatcaaaatcatggacacattgagaaggatgaatcctgggttccagtatgtgattaactatcttcctctatagttatttttgattcaattaaatttatttatttaattaagttcaagaaaaatggaatctttatacttcagaataaagtct

SEQ ID NO: 2680 - DNA, 805 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcgatggccaccacctgctccggggtcaagccgtgggcctggcacagcaccggcaacagccgctggaccgtctccagcgcctgcttgccaccattattgctggcgatggccaccttgcattcctcaattcttgtgccataccatggatggttagttcatcccggctttttgtttgtcattggaagttcttttattgattcaatttttatagcgtgttcggaaacgcgtttcagaaaataatgaaatacatcttgaatctgaaagtataacttttagcttcattgtcattgaaagttcttttattaattatatttttattgcgtgtttggaatcccatttgagaaataagaaatcacgtttaaaagtgttgaaagttataactattaacttttgactaaacttgaaaaaaactcacatttttgatgtggaaccaaaattctgatttgagaaccaagttgattttgatggattttggcaggagaattagcccacagaactcaccatcaaaattcatggacacattgagaagggatgaaatcctgggttccagtatgtgattaactacttcctctatagttattttttggattcaattaattttatttattaataagttcaagaaaaacggaatctttatacttcagataaa

SEQ ID NO: 2681 - DNA, 696 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtggggcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaaaggaatctttatacttcagataaagctg

SEQ ID NO: 2682 - DNA, 738 bp, Artificial; identical to SEQ ID NO: 2043
  Glycine max FAD3A mutation created with TALEN pair GmFAD3_T02.1

SEQ ID NO: 2683 - DNA, 480 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaatgtgaaagttataactattaactttgactaaactgaaaaaatcacatttttgatgtggaaccaaa

SEQ ID NO: 2684 - DNA, 761 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatccagcaataatggtggcaagcaggcgctggagacggtccagcggctgttgccggtgctgtgccaggcccacggcttgaccccccagcaggtggtggccatcgccgaccctgccgcttaccggatacctgtccgcctttctcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttatacttttagcttcattgtcattgaaagttcttttattaattatattttattgcgtgtttggaatcccatttgagaataagaaatcacgtttaaaatgtgaaagttataactattaactttgactaaacttgaaaaatcacatttttgatgtggaaccaaatctgatttgagaaccaagttgattttgatggattttgcaggagaattagccacagaactcaccatcaaaatcatggacacattgagaaggattgaatccctgggttccagtatgtgattaactacttcctctat

SEQ ID NO: 2685 - DNA, 726 bp, Artificial
  Glycine max FAD3A mutation created with TALEN pair GmFAD3_T02.1
  misc_feature (251): n is a or c or t or g
cactgctttgttatgcctacctcatttcatttggctttagacaacttaaatttgagatctttattatgttttttgcttatatggtaaagtgattcatcttcatcatgaattgaatacagtggccatggaagcttttcagacagcccttttctaaatagcctggtgggacacattcctcaattcttgtgccataccatggatggttagttcatcccggcttttttgtttgtcattggaagttcttttattgnttcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttattttatttaataagttcaagaaaaaaggaatctttatacttcagataaagctgttcttgaacattttttttcgtcattatc

SEQ ID NO: 2686 - DNA, 737 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacactgctatcctccaattcattgttgcatcaccactgatggattgatgttgtcatccccggctttttttgtttgtcattggaagttcttttattgattcaatttttatagcgtgttcggaaacgcgtttcagaaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttcgtcattatc

SEQ ID NO: 2687 - DNA, 737 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacagcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacattttttttcgtcattatcttagttaaccg

SEQ ID NO: 2688 - DNA, 631 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacaccgttacagttggacacaggccaacttctcaagattgcaaaacgtggcggcgtgaccgcagtgttgcattcctcaattcttgtgccataccatggatggttagttcatcccggctttttgttttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaatcacattttgatgtggaaccaaatctgatttgagaaccaagttgattttgatggattttgcaggagaattagccacagaactcaccatcaaaatcatggacac

SEQ ID NO: 2689 - DNA, 738 bp, Artificial
  Glycine max FAD3A mutation created with TALEN pair GmFAD3_T02.1
  misc_feature (683): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacttgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttataagttcaagaaaaatggaatctttntacttcagataaagctgttcttgaacattttttttcgtcattatctagttaaccg

SEQ ID NO: 2690 - DNA, 782 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcgccagcaatggcggtggcaagcaggcgctggagacggtccagcggctgttgccggtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaatcacattttgatgtggaaccaaatctgatttgagaaccaagttgattttgatgggattttgcaggagaattagccacagaactcaccatcaaaatcatggacacaattgagaaggatgaatcctgggttccagtatgtgattaactacttcctctatagttatttttgattcaattaaatttatttatttaataagttcaagaaaaaaagggaatctttatacttcagataaagctgttcttgaacattttttttgtcattattctagtttaaccga

SEQ ID NO: 2691 - DNA, 645 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagccctttagacaacttatatttgcattcctcaattcttgtgccataccatggatggttagttcatcccggcttttttcgtttgtcattggaagttctttttattgattcaatttttatagcgtgttcggaaacgcgtttcagaaaattaatgaaaatacatcttgaatctgaaaagttataacttttagcttcattgtcattgaaagttcttttattaattatatttttattgcgtgtttggaatcccatttgagaaataagaaatcacgtttaaaaatgtgaaagttataactattaacttttgactaaaacttgaaaaaaactcacatttttgatgtggaaccaaaatctgatttgagaaccaagttgattttgatggattttgcaggagaattagccacagaactcaccatcaaaagtcatgggacacattgagaaggatgaatcctgggttccagtatgtgattaacctacttcctctatagttatttttcgattcaatt

SEQ ID NO: 2692 - DNA, 732 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactaacttcctctatagttatttttgattcaattaaatttattttattttaataagttcaagaaaaataggaaatctttataacttcagataaagctgttcttgaacattttttttgtcattatct

SEQ ID NO: 2693 - DNA, 737 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacagcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggatttgcaggagaattagccacagaactcaccatcaaaatcatggacacattgagaaggatgaatcctgggttccagtatgtgattaactacttcctctatagttatttttgattcaattaaatttattttatttaataagttcaagaaaaatggaatctttatacttcagataaagctgttcttgaacattttttttcgtcattatctagttaaccg

SEQ ID NO: 2694 - DNA, 726 bp, Artificial
  Glycine max FAD3A mutation created with TALEN pair GmFAD3_T02.1
  misc_feature (680): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacagcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttataagttcaagaaaaatggaatctttntacttcagataaagctgttcttgaacattttttttcgtcattatct

SEQ ID NO: 2695 - DNA, 735 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacattcctcaattcttgtgccataccatggatggttagttcatcccggcttttttgtttgtcattggagttcttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttcgtcattatctagttaaccg

SEQ ID NO: 2696 - DNA, 621 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggatttgcaggagaattagccacagaactcaccatcaaaatcatggacacattgagaaggatgaatcctgggttccagtatgtgattaactacttcctctata

SEQ ID NO: 2697 - DNA, 696 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacatctccagcgcctgcttgccaccattattgctggcgatggccaccacctgctggggggtcaagccgtgggcctggcacagcaccggcaacagcgtcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgttggaatcccatttgagaatagaatcacgtttaaatgtgaaagttataactattaactttgactaaacttgaaaaagtcacatttttgatgtggaaccaaatctgatttgagaaccaagttgattttgatggattttgcagggagaattagccacagaactcaccatcaaaatcatggacacattgagaagggatgaatcctgggttccagtatgtgatt

SEQ ID NO: 2698 - DNA, 716 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcgctggagacggtccagcggctgttgccggtgctgtgccaggcccacggcttgaccccggagcaggtggtggccatcgccagccacgatggcggcaacagccgctggaccattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatattttattgcgtgtttggaatcccatttgagaaataagaatcacgtttaaaatgtgaaagttataactattaacttttgactaaatcttgaaaaaaactcacattttgtgtggaaccaaatctgattgagaccaatgttgattttgatggattttgcaggaagaattagccacagaactcaccatcaaaatcatggacacattgagaaggatgaatcctgggttccagtatgtgattaact

SEQ ID NO: 2699 - DNA, 738 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggatttgcaggagaattagccacagaactcaccatcaaaatcatggacacattgagaaggatgaatcctgggttccagtatgtgattaactacttcctctatagttatttttgattcaattaaatttatttatttaaataagttcaagaaaaatggaatctttatacttcagataaagctgttcttgaacattttttttgtcattatctagttaaccg

SEQ ID NO: 2700 - DNA, 599 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacacgacttatcgccactggcagcagccactggtaacaggattagcagagcgaggtatgtaggcggtgctacagagttcttcttgcattcctcaattcttgtgccataccatggatggttagttcatcccggcttttttgttttgtcattggaagttctttttattgattcaatttttatagcgtgttcggaaacgcgtttcagaaaagtaatgaaatacatcttgaatctgaaagttataacttttagcttcattgtcattgaaagttcttttattaattatattttattgcgtgttggaatcccatttgagaataagaatcacgtttaaaatgtgaaagttataactattaactttgactaaacttgaaaaagtcacatttttgatgtggaaccaaatctgatttgagaaccaagttgattttgatgga

SEQ ID NO: 2701 - DNA, 744 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacaattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgcctgattaactacttcctctatagttatttttgattcaattaaattttattttatttaattaaagtttcaagaaaaaatggaatctttataacttcagataaagctgttcttgaacattttttttcgtcattatctagttaaccga

SEQ ID NO: 2702 - DNA, 734 bp, Artificial
  Glycine max FAD3A mutation created with TALEN pair GmFAD3_T02.1
  misc_feature (679): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacttgcattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaacgtcaccatcaaaatcatggacacattgagaaggatgaatcctgggttccagtatgtgattaactacttcctctatagttatttttgattcaattaaatttatttattataagttcaagaaaaatggaatctttntacttcagataaagctgttcttgaacattttttttcgtcattatctagttaaccg

SEQ ID NO: 2703 - DNA, 642 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacagcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaagtcatggacacattgagaaggatgaatcctgggttccagtatgtgattaactacttcctctatagttatttttgattcaatt

SEQ ID NO: 2704 - DNA, 735 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggattgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacattttttttcgtcattatcttagttaaccg

SEQ ID NO: 2705 - DNA, 735 bp, Artificial; identical to SEQ ID NO: 2479
  Glycine max FAD3A mutation created with TALEN pair GmFAD3_T02.1
  misc_feature (680): n is a or c or t or g

SEQ ID NO: 2706 - DNA, 732 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaaactcaccatcaaaatcatggacacattgagaaggatgaatcctgggttccagtatgtgattaactacttcctctatagttatttttgattcaattaaatttatttatttataagttcaagaaaaatgaatctttatacttcagataaagctgttcttgaacatttttttttcgtcattatctagttaacc

SEQ ID NO: 2707 - DNA, 454 bp, Artificial
  Glycine max FAD3A mutation created with TALEN pair GmFAD3_T02.1
cactgctttgttatgcctacctcatttcatttggctttagacaacttaaatttgagatctttattatgtttttgcttatatggtaaagtgattcattcttcacattgaattgaacagtggccatggaagcttttcagacagcccttttctaaatagcctggtgggacacacgggcccgtcgactgcagaggcctgcatgcaagcttggcgtaatcatggtcatagctgtttcctgtgtgaaattgttatcctgcattcctcaattcttgtgccataccatggatggttagttcatcccggctttttgtttgtcattggaagttcttttattgattcaatttttatagcgtgttcggaaacgcgtttcagaaaataatgaaatacatcttgaaatctgaaagttataacttttagcttcattgtcattgaaagttcttttattaattatatttta

SEQ ID NO: 2708 - DNA, 690 bp, Artificial
  Glycine max FAD3A mutation created with TALEN pair GmFAD3_T02.1
  misc_feature (681): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaatttatttatttataagttcaagaaaaatggaatctttntacttcaga

SEQ ID NO: 2709 - DNA, 684 bp, Artificial
  Glycine max FAD3A mutation created with TALEN pair GmFAD3_T02.1
cactgctttgttatccctacctcatttcatttggctttagacaacttaaatttgagatctttattatgttttttgcttatatggtaaagtgattcattcttcacattgaattgaacagtggccatggaagcttttcagacagcccttttcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttcttttattaattatatttttaattgcgtgtttggaatcccatttgagaaaataagaaatcacgtttaaaatgtgaaagttataactattaactttgactaaacttgaaaaaattcacattttgatgtggaaccaaatctgatttgagaaccaagttgattttgatggattttgcaggagaattagccacagaactcaccatcaaaaatcatggacacattgagaaggatgaatcctgggttccagtatgtgattaactactcctctatagttattttgattcaattaaaatttatttatttaataagttcaagaaaaaaggaatctttatacttcagataaagctgttcttgaacatttttttta

SEQ ID NO: 2710 - DNA, 736 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacttgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttcgtcattatctagttaaccg

SEQ ID NO: 2711 - DNA, 621 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacatattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatag

SEQ ID NO: 2712 - DNA, 708 bp, Artificial
  Glycine max FAD3A mutation created with TALEN pair GmFAD3_T02.1
  misc_feature (541): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacttgccggtgctgtgccaggcccacggcttgaccccggagcaggtggtggccatcgccagcaatggcggtggcaagcaggcgctggagacggtccagcggctgttgccggtgctgtgccaggcccacggcttgaccccggagcaggtggtggccatcgccagcaattcctcaattcttgtgccataccatggatggttagttcatcccggcttttttgtttgtcattggaagttcttttattgattcaatttttatagcgtgttcggaaacgcgtttcagaaaattaatgaaatacatcttgaatctgaaagttataacttttagcttcattgtcattgaaagttcttttattaattatatttttattgcgngtttggaatcccatttgagaaataagaaatcacgtttaaaatgtgaaatgttataactattaacttttgactaaacttgaaaaactcacatttttgatgtggaaccaaatctgatttgagaaccaagttgattttgatggattttgcaggagaattagccacagaac

SEQ ID NO: 2713 - DNA, 730 bp, Artificial
  Glycine max FAD3A mutation created with TALEN pair GmFAD3_T02.1
  misc_feature (675): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacactcaattcttgtgccataccatggatggttagttcatcccggcttttttgtttgtcattggaagttcttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttntacttcagataaagctgttcttgaacattttttttcgtcattatctagttaaccg

SEQ ID NO: 2714 - DNA, 809 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacaggccaacttctcaagattgcaaaacgtggcggcgtgaccgcagtggaggcagtgcatgcatggcgcaatgcactgacgggtgccccgctcaacttgacccccagcaggtggtggccatcgccagcaataatggttgcattcctcaattcttgtgccataccatggatggttagttcatcccggctttttgtttgtcattggaagttcttttattgattcaattttatagcgtgttcggaaacgcgtttcagaaaataatgaaatacatcttgaatctgaaagttataacttttagcttcattgtcattgaaagttcttttattaattatatttttattgcgtgtttggaaatcccatttgagaaataagaaatcacgtttaaaatgtgaaagttataactattaactttgactaaacttgaaaaatcacatttttgatgtggaaccaaatctgatttgagaaccaagttgatttttgatggattttgcaggagaattagccacagaactcaccatcaaaatcatggacacattgagaaggatgaatccctgggttccagtatgtgattaactacttcctctatagttattttttgattcaattaaatttatttattaataagttcaagaaaaaggatc

SEQ ID NO: 2715 - DNA, 694 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaagggaatctttatacttcagataaagctg

SEQ ID NO: 2716 - DNA, 734 bp, Artificial
  Glycine max FAD3A mutation created with TALEN pair GmFAD3_T02.1
  misc_feature (680): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttntacttcagataaagctgttcttgaacattttttttgtcattatctagttaaccg

SEQ ID NO: 2717 - DNA, 738 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaacctacttcctctatagttatttttgattcaattaaatttatttatttaataagttcaagaaaaaggaatctttatacttcagataaagctgttcttgaacattttttttcgtcattatcttagttaaccg

SEQ ID NO: 2718 - DNA, 628 bp, Artificial
  Glycine max FAD3A mutation created with TALEN pair GmFAD3_T02.1
cactgctttgttaatgcctacctcatttcatttggctttagacaacttaaatttgagatctttattatgttttttgcttatatggtaaagtgattcattcttcacattgaattgaacagtggccatggaagcttttcagacagcccttttctaaatagcctggtggggcattcctcaattcttgtgccataccatggatggttagttcatcccggcttttttgtttgtcattggaagttcttttattgattcaatttttatagcgtgttcggaaaaccgcgtttcagaaaactaatgaaatacatcttgaatctgaaaagttataacttttagcttcattgtcattgaaaagttcttttattaattatatttttattgcgtgtttggaatcccatttgagaaataagaaatcacgtttaaaaatgtgaaagttataactattaacttttgactaaacttgaaaaaattcacatttttgatgtggaaccaaatctgatttgagaaccaagttgattttgatggattttgcaggagaattagccacagaactcaccatcaaaattcatggacacattgagaaggatgaatcctgggttccagtatgtgattaactacttcctctatagtt

SEQ ID NO: 2719 - DNA, 474 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatctgctgaagccagttaccttcggaaaaagagttggtagctcttgatccggcaaacaaaccaccgctggtagcggtggtttttttgtttgcaagcagcagattacgcgcagaaaaaaagggatctcaagaagatcctttgcattcctcaattcttgtgccataccatggatggttagttcatcccggcttttttcgtttgtcattggaagttcttttattgattcaatttttatagcgtgttcggaaacgcgtttcagaaaataatgaaatacatcttgaatctgaaagttataacttttagc

SEQ ID NO: 2720 - DNA, 732 bp, Artificial
  Glycine max FAD3A mutation created with TALEN pair GmFAD3_T02.1
  misc_feature (677): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagccctttagacaacttatatttgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttntacttcagataaagctgttcttgaacattttttttcgtcattatctagttaaccg

SEQ ID NO: 2721 - DNA, 736 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacagcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaatcttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaatttatttatttataagttcaagaaaaatggaatctttatacttcagataaagctgttcttgaacattttttttcgtcattatctagttaaccg

SEQ ID NO: 2722 - DNA, 741 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggattgcattcctcaattcttgtgccataccatggatggttagttcatcccggcttttttgtttgtcattggaagttctttttattgattcaatttttatagcgtgttcggaaacgcgtttcagaaaataatgaaaatacatctgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttttgattcaattaaatttattttatttaataagttcaagaaaaaaaggaatctttatacttcagataaagctgttcttgaacatttttttttcgtcattatcttagttaaccg

SEQ ID NO: 2723 - DNA, 458 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggactcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaataagaatcacgtttaaaatgtgaagttataactataactttgactaaactgaaaaaatcaca

SEQ ID NO: 2724 - DNA, 734 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttcgtcattatctagttaaccg

SEQ ID NO: 2725 - DNA, 729 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagtttcaagaaaaatggaatctttatacttcagataaagctgttcttgaacatttttttcgtcattatctag

SEQ ID NO: 2726 - DNA, 699 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcctcaattcttgtgccataccatggatggttagttcatcccggctttttgtttgtcattggaagttcttttattgatcaatttttatagcgtgttcggaaacgcgtttcagaaaataatgaatacatcttgaatctgaaagttataacttttagcttcattgtcattgaagttcttttattaattatattttattgcgtgtttggaatcccatttgagaaataagaaatcacgtttaaaatgtgaaagttataactattaacttttgactaaaacttgaaaaaaactcacatttttgtgtgggaaccaaattctgattgagaaccaatgttgatttgatggattttgcaggagaattagccacagaatctcaccatcaaaatcatggacacattgatg

SEQ ID NO: 2727 - DNA, 735 bp, Artificial
  Glycine max FAD3A mutation created with TALEN pair GmFAD3_T02.1
  misc_feature (529): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggatgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggngaattagcccacagaactcaccatcaaaatcatgggacacattgagaaggatgaatcctgggttccagtatgtgattaactacttcctctatagttatttttgattcaattaaatttatttatttataagttcaagaaaaaggatctttatacttcagataaagctgttcttgaacattttttttcgtcattatcttagttaaccg

SEQ ID NO: 2728 - DNA, 699 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaatttatttatttaataagttcaagaaaaaggaatctttatacttcagataaagctgttc

SEQ ID NO: 2729 - DNA, 701 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatattttattgcgtgtttggaatcccatttgagaaataagaaatcacgtttaaaatgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaagggaatctttatacttcagataaagctgttcttgaacatttttttagtcattatcttag

SEQ ID NO: 2730 - DNA, 741 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacatacaatctgctctgatgccgcatagttaagccagccccgacacccgccatgcattcctcaattcttgtgccataccatggatggttagttcatcccggctttttttgttgtcattggaagttcttttattgattcaatttttaagcgtgttcggaaacgcgtttcagaaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaaattaaaatttatttattttaataagttcaagaaaaaggaaatctttatacttcagataaagctgttcttgaacattttttttt

SEQ ID NO: 2731 - DNA, 733 bp, Artificial
  Glycine max FAD3A mutation created with TALEN pair GmFAD3_T02.1
  misc_feature (678): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttntacttcagataaagctgttcttgaacattttttttcgtcattatctagttaaccg

SEQ ID NO: 2732 - DNA, 734 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggattgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaattatttatttaataagttcaagaaaaaaggaatctttatacttcagataaagctgttcttgaacattttttttgtcattatcttagttaaccg

SEQ ID NO: 2733 - DNA, 701 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacattgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagtttcaagaaaaaggaatctttatacttcagataaagctg

SEQ ID NO: 2734 - DNA, 731 bp, Artificial
  Glycine max FAD3A mutation created with TALEN pair GmFAD3_T02.1
  misc_feature (677): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggagcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaatttatttatttaataagttcaagaaaatggaatctttntacttcagataaagctgttcttgaacattttttttcgtcattatctagttaacc

SEQ ID NO: 2735 - DNA, 730 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcagcaccggcaacagccgctggaccgtctccagcgcctgcttgccaccattattgctggcgatggccaccacctgctggggggtcaagccgtgggcctggttgcattcctcaattcttgtgccataccatggatggttagttcatcccggctttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatattttattgcgtgttggaatcccatttgagaaatagaaatcacgtttaaatgtgaaagttataactattaacttttgactaaacttgaaaaatcacatttttgatgtggaaccaaatctgatttgagaaccaagttgattttgatggattttgcaggagaattagccacagaacttcaccattcaaaatcatggacacattgagaaggatgaatcctgggttccagtatgtgattaactacttcctctatagttatttttt

SEQ ID NO: 2736 - DNA, 736 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaaatgtgaaagttataactattaacttttgactaaacttgaaaaaattcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaaagggaatctttatacttcagataaagctgttcttgaacatttttttagtcattatcttagttaaccgag

SEQ ID NO: 2737 - DNA, 751 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacaatcgccaccaatattggtggcaagcaggcgatggccaccacctgctggggggtcaagccgtgggcctggcacagcaccggcaacagccgctggaccgtctccagcgcctgcttgccaccgccattgcattcctcaattcttgtgccataccatggatggttagttcatcccggctttttgtttgtcattggaagttcttttattgattcaatttttatagcgtgttcggaaacgcgtttcagaaataatgaaatacatcttgaatctgaaagttataacttttagcttcattgtcattgaaagttcttttattaattatattttattgcgtgtttggaatcccatttgagaaataagaatcacgtttaaaatgtgaaagttatactattaactttgactaaacttgaaaaaatcacatttttgatgtggaaccaaatctgatttgagaaccaagttgattttgatggattttgcaggagaattagccacagaaactcaccatcaaaatcatggacacattgagaagggatgaaatcctgggttccagtatgtgattaactacttcctctatagttgattttt

SEQ ID NO: 2738 - DNA, 431 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacagcattcctcaattcttgtgccataccatggatggttagttcatcccggcttttttgttttgtcattggaagttcttttattgattcaatttttatagcgtgtttcggaaacgcgtttcagaaaataatgaaaattacatctttgaatctgaaaagttataacttttagcttcatttgtcattgaaagttcttttattaattatattttttattgcgtgtttggaatcccatttgagaaataagaaaatcacgtttaaaatgt

SEQ ID NO: 2739 - DNA, 613 bp, Artificial
  Glycine max FAD3A mutation created with TALEN pair GmFAD3_T02.1
  misc_feature (391): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaaatcacgtttaaaatgtgaaagttataactattaacttttgactaaaacttgaaaaaatcacatttttgatgnggaaccaaatctgatttgagaaccaaagttgattttgatggattttgcaggagaattagccacagaactcaccatcaaaatcatggacacattgagaaggatgaatcctggttccagtatgtgataactacttcctctatagttattttgattcaattaaatttatttatttaataagttcaagaaaaaaggaatctttatacttcagataaagctgttctt

SEQ ID NO: 2740 - DNA, 695 bp, Artificial
  Glycine max FAD3A mutation created with TALEN pair GmFAD3_T02.1
cactgctttgttatgcctacctcatttcatttggctttagacaacttaaattttgaggtctttattatgttttttgcttatatggtaaagtgattcattcttcacattgaattgaacagtggccatggaagcttttcagacagcccttttctaaatagcctggtgggagaattcctcaattcttgtgccataccatggatggttagttcatcccggcttttttgttttgtcattggaagttctttttattgattcaattttttatagcgtgttcggaaacgcgtttcagaaaataatgaaaatacatcttgaatctgaaaagttataacttttagcttcattgtcattgaaagttctttttattaaattatattttttattgcgtgttttggaatcccattttgagaaataagaaaatcacgtttaaaaatgtgaaagttataactattaacttttgactaaaacttgaaaaaaactcacatttttgatgtggaaccaaatctgatttgagaaccaagtttgatttttgatggattttgcaggagaattagccacagaactcaccatcaaaaatcatgggacacattgagaaggatgaatcctgggttccagtatgtgattaactacttcctctatagttattttttgattcaattaaatttattttatttaataagttcaagaaaaatggaatc

SEQ ID NO: 2741 - DNA, 705 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttgtgccataccatggatggttagttcatcccggcttttttgtttgtcattgggaagttcttttattgattcaatttttatagcgtgttcggaaacgcgtttcagaaaataatgaaatacatcttgaatctgaaagttataacttttagcttcattgtcattgaaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgatttttgatggattttgcaggagaattagccacagaactcaccatcaaaaatcatggacacattgagaaggatgaatcctgggttccagtatgtgattaactacttcctctatagttatttttgattcaattaaaatttatttatttaataagttcaagaaaaaaggaatctttatacttcagataaagctgttcttgaacattttttttgtcattatcttagttaaccgag

SEQ ID NO: 2742 - DNA, 644 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacagcgcctgcttgccgccatcgtggctggcgatggccaccacctgctccggggtcaagccgtgggcctggcacagcaccggcaacagccgctggaccggcaacagcgcctgcaccgtctccagcgcctgcttgccaccattattgctggcgatggccaccacctgctccggggtcaagccgtgggcctggttcctcaattcttgtgccataccatggatggttagttcatcccggcttttttgtttgtcattggaagttcttttattgattcaatttttatagcgtgttcggaaacgcgttcagaaaataatgaaatacatcttgaatctgaaagttataacttttagcttcattgtcattgaaagttctttattaattatatttttattgcgtgtttggaatcccatttgagaaataagaatcacgtttaaaatgtgaaagttataactattaactttgactaaacttgaaaaa

SEQ ID NO: 2743 - DNA, 675 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaattcggcttttttgtttgtcattggaagttcttttattgattcaatttttatagcgtgttcggaaacgcgtttcagaaaataatgaaatacatcttgaatctgaaagttataacttttagcttcattgtcattgaaaagttcttttattaattatatttttattgcgtgttttggaatccatttgagaaataagaaaatcacgtttaaaatgtgaaagttataactattaacttttgactaaacttgaaaaaatcacatttttgatgtggaaaccaaatctgatttgagaaccaagttgatttttgatggatttttgcaggagaattagccacagaactcaccatcaaaaatctggacacatttgagaaggatgaatcctgggttccagtatgtgattaactacttcctctatagttatttttgattcaattaaatttattatttaataagttcaagaaaaaaggaatctttatacttcagataaagctgttacttgaacattttttttgtcattatcttag

SEQ ID NO: 2744 - DNA, 736 bp, Artificial
  Glycine max FAD3A mutation created with TALEN pair GmFAD3_T02.1
  misc_feature (681): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacattcctcaattcttgtgccataccatggatggttagttcatcccggcttttttgtttgtcattggaagttctttttattgattcaatttttatagcgtgttcggaaacgcgtttcagaaaataatgaaaatacaacttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttntacttcagataaagctgttcttgaacattttttttcgtcattatctagttaaccg

SEQ ID NO: 2745 - DNA, 541 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcatttttcacattgaattgaacattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttcttttattaattatatttttattgcgtgtttggaatcccattgagaaaataagaaaatcacgtttaaaaatgtgaaaagttataactattaacttttgactaaaacttgaaaaaatcacatttttgatgtggaaccaaatctgatttgagaaccaaagttgattttgatggattttgcaggagaattagccacagaactcaccatcaaaaatcatggacaacattgagaaggatgaatcctggg

SEQ ID NO: 2746 - DNA, 736 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttattttatttaataagttcaagaaaaatggaatctttatacttcagataaagctgttcttgaacattttttttcgtcattatctagttaaccg

SEQ ID NO: 2747 - DNA, 723 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaatggcattcctcaatttcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggattccagtatgtgattaactacttcctctatagttattttgattcaattaaatttatttattaataagttcaagaaaaaaggaatctttatacttcagataaagctgttcttgaacatttttttgtcattatcttagttaaccgag

SEQ ID NO: 2748 - DNA, 735 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacactattgctggcgatggccaccacctgctccggggtcaagccgtgggcctggcacagcaccggcaacagcgcctggaccgtctccagcgcctgcttgccaccaaactcaattcttgtgccataccatggatggttagttcatcccggcttttttggtttgtcattggaagttcttttattgattcaatttttatagcgtgttcggaaacgcgtttcagaaataatgaaatacatcttgaatctgaaagttataacttttagcttcattgtcattgaaaagttcttttattaattatattttattgcgtgttggaatccccatttgagaaataagaatcacgtttaaatgtgaaagttataactattaactttgactaaacttgaaaaaagtcacatttttgatgtggaaccaaatctgatttgagaaccaagttgattttgatggattttgcaggagaattagccacagaacctcaccatcaaaattcatggacacattgagaagggatgaatcctgggttccagtatgtgattaactacttcctctatagttatttttggattcaa

SEQ ID NO: 2749 - DNA, 744 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggcggctccaggaagcccgacggcgccatctacaccgtgggctcccccatcgactacggcgtgatcgtggacaccaaggcctactccggcggctacaacctgcccatcggccaggccgacgaagcattcctcaattcttgtgccataccatggatggttagttcatcccggctttttgtttgtcattggaagttcttttattgattcaatttttatagcgtgttcggaaacgcgtcatcgaaaataatgaaatacatcttgaatctgaaagttataacttttagcttcattgtcattgaaagttcttttattaattatattttattgcgtgttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaagggatgaatcctgggttccagtatgtgattaactacttcctctatagttattttt

SEQ ID NO: 2750 - DNA, 724 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttattttatttaataagttcaagaaaaaaggaatctttatacttcagataaagctgttcttgaacattttttttgtcatatctt

SEQ ID NO: 2751 - DNA, 710 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacttgccggtgctgtgccaggcccacggcttgaccccggagcaggtggtggccatcgccagcaatggcggtggcaagcaggcgctggagacggtccagcggctgttgccggtgctgtgccaggcccacggcttgaccccggagcaggtggtggccatcgccagcaattcctcaatttcttgtgccataccatggatggtttagttcatcccggcttttttggtttgtcattggaagttctttttattgattcaatttttatagcgtgttcggaaacgcgtttcagaaaataatgaaatacatcttgaatctgaaagttataacttttagcttcattgtcattgaaagttcttttattaattatattttattgctgtgtttggaatcccatttgagaaataagaaatcacgtttaaaatgtgaaatgttataactattaacttttgactaaacttgaaaaatcacatttttgatgtggaaccaaatctgatttgagaaccaagttgattttgatggattttgcaggagaattagccacagaac

SEQ ID NO: 2752 - DNA, 624 bp, Artificial; identical to SEQ ID NO: 1629
  Glycine max FAD3A mutation created with TALEN pair GmFAD3_T02.1

SEQ ID NO: 2753 - DNA, 617 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacagcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaaatcacgtttaaaaatgtgaaagttataactattaacttttgactaaacttgaaaaaatcaacattttgatgtggaaccaaatctgatttgagaaccaagttgattttgatggattttgcaggagaattagccacagaactcaccatcaaaatcatggacaacattgagaaggatgaatcctgggttccagtatgtgattaactactt

SEQ ID NO: 2754 - DNA, 726 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaatgtgaagttataactattaacttttgactaaacttgaaaaaattcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaataattattattaataagttcaagaaaaaggaatcttatacttcagataaagctgttcttgaacatttttttgtcattatcttagtaaccgagaag

SEQ ID NO: 2755 - DNA, 737 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggatgcattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacatttttgatgtggaaccaaatctgatttgagaaccaagttgattttgatggattttgcaggagaattatgccacagaactcaccatcaaaatcatggacacattgagaaggatgaatcctgggttccagtatgtgattaactacttcctctatagttatttttgattcaattaaatttatttatttaataagttcaagaaaaaggaagtctttatacttcagataaagctgttcttgaacattttttttcgtcattatcttagttaaccg

SEQ ID NO: 2756 - DNA, 708 bp, Artificial
  Glycine max FAD3A mutation created with TALEN pair GmFAD3_T02.1
cactgctttgtatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacacgggcccgtcgactgcagaggcctgcatgcaagcttggcgtaatcatggtcatagctgtttcctgtgtgaaattgttatcctgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatattttattgcgtgttggaatcccatttgagaaatagaaatcacgtttaaaatgtgaaagttataactattaactttgactaaacttgaaaaaatcacatttttgatgtggaaaccaaatctgatttgagaaccaagttgattttgatggattttgcaggagaattagccacagaactcaccatcaaaatcatggacacattgagaaggatgaatcctgggttccagtatgtgattaactacttcctctatagttattttt

SEQ ID NO: 2757 - DNA, 737 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggaattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaatgtgaaagttataactattaacttttgactaaacttgaaaaaattcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaagggaatctttatacttcagataaagctgttcttgaacattttttttagtcattatcttagttaaccgag

SEQ ID NO: 2758 - DNA, 731 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattgcaatttaaaatttatttatttaataagttcaagaaaaatggaaatctttatacttcagataaagctgttcttgaacattttttttgtcattatct

SEQ ID NO: 2759 - DNA, 737 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacatgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttcgtcattatctagttaaccga

SEQ ID NO: 2760 - DNA, 738 bp, Artificial; identical to SEQ ID NO: 1795
  Glycine max FAD3A mutation created with TALEN pair GmFAD3_T02.1

SEQ ID NO: 2761 - DNA, 650 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaaatcatttatgttttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaaagttataactattaacttttgactaaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttataacttcagataaagctgttcttgaacattttttttgtcattattcttagtt

SEQ ID NO: 2762 - DNA, 808 bp, Artificial
  Glycine max FAD3A mutation created with TALEN pair GmFAD3_T02.1
  misc_feature (767): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatgcaaatatttcttgtcaaaaatgctccactgacgttccataaattcccctcggtatccaattagagtctcatcttgcattcctcaattcttgtgccataccatggatggttagttcatcccggctttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaactcacatttttgatgtggaaccaaaattctgatttgagaaccaagttgattttgatggattttgcaggagaattagccacagaactcaccatcaaaatcatggacacattgagaagggatgaatcctgggttccagtatgtgattactacttcctctatagttattttttggattcaatttaaattttattttatttaataagttcaagaaaaaaggaatctttatncttcagataaagctgttctttgaaacatttttttttcgtca

SEQ ID NO: 2763 - DNA, 649 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaacttcaccatcaaaatcatggacacattgagaaggatgaatcctgggttccagtatgtgattaactacttcctctatagttatttttgattcaattaaatttatttattt

SEQ ID NO: 2764 - DNA, 657 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcattcctcaattcttgtgccataccatggatggttagttcatcccggcttttttgtttgtcattggaagttcttttattgattcaatttttatagcgtgttcggaaacgcgtttcagaaataatgaaatacatcttgaatctgaaagttataacttttagcttcattgtcattgaaaagttcttttattaattatatttttaattgcgtgtttggaatcccatttgagaaataagaaatcacgtttaaaattgtgaaagttataactattaacttttgactaaacttgaaaaaattcacatttttgatgtggaaccaaatctgatttgagaaccaagttgattttgatggattttgcaggagaattagccacagaactcaccatcaaaaatcatggacacattgagaaggatgaatcctgggttccagtatgtgattaactacttcctctatagttatttttgattcaattaaaatttatttatttaataagttcaagaaaaagggaatctttatacttcagataaa

SEQ ID NO: 2765 - DNA, 741 bp, Artificial
  Glycine max FAD3A mutation created with TALEN pair GmFAD3_T02.1
  misc_feature (696): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacatgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttattttatttaataagtttcaagaaaaatggaatctttatacttcaganaaagctgttcttgaacattttttttcgtcattatctagttaaccg

SEQ ID NO: 2766 - DNA, 612 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacttgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggatgaattagccacagaactcaccatcaaaatcatggacacattgagaaggatgaatcctgggttccagtatgtgattaactac

SEQ ID NO: 2767 - DNA, 631 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggattgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttt

SEQ ID NO: 2768 - DNA, 755 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacaggtggtttgtttgtcggatcaagagctaccaactctttttccgaaggtaactggctttgcattcctcaattcttgtgccataccatggatggttagttcatcccggcttttttgtttgtcattggaagttcttttattgattcaatttttatagcgtgttcggaaaacgcgtttcagaaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaatcacattttgatgtggaaccaaatctgattgagaaccaagttgatttgatggattttgcaggagaattagccacagaactcaccatcaaaatcatggacacattgagaaggatgaatcctgggttccagtaatgtgattaactacttcctctatagttatttttgattcaattaaatttatttatttaataagttcaaatgaaaaaggaatctttatacttcagataaag

SEQ ID NO: 2769 - DNA, 734 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacattttttttcgtcattatcttagttaaccg

SEQ ID NO: 2770 - DNA, 548 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacttgcattcctcaattcttgtgccataccatggatggttagttcatcccggctttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttaattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacag

SEQ ID NO: 2771 - DNA, 616 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggatgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattgagccacagaactcaccatcaaaatcatggacacattgagaaggatgaatcctgggttccagtatgtgattaactacttccc

SEQ ID NO: 2772 - DNA, 724 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggagcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttataagttcaagaaaaaggaatctttatacttcagataaagctgttcttgaacattttttttcgtcattact

SEQ ID NO: 2773 - DNA, 836 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacactggaccgtctccagcgcctggttgccaccgccattgctggcgatggccaccacctgctggggggtcaagccgtgggcctggagacggtccagcggctgttcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaatcacattttgatgtggaaccaaatctgatttgagaaccaagttgattttgatggattttgcaggagaattagccacagaactcaccatcaaaatcatggacacattgagaagggatgaatcctgggttccagtatgtgattaactacttcctctatagttattttttggattcaattaattttattttatttaataagttcaagaaaaacggaatctttatacttcagataaagctgttcttgaaacattttttttcgtcattatctttagttaacc

SEQ ID NO: 2774 - DNA, 784 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacaggccaacttctcaagattgcaaaacgtggcggcgtgaccgcagtggaggcagtgcatgcatggcgcaatgcactgacgggtgccccgctcaacttgacccccagcaggtggtggccatcgccagcaataatggttgcattcctcaattcttgtgccataccatggatggttagttcatcccggctttttgtttgtcattggagttcttttattgattcaattttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaactttgactaaacttgaaaaatcacatttttgatgtggaaccaaatctgatttgagaaccaagttgatttttgatggattttgcaggagaattagccacagaactcaccatcaaatcatggacacattgagaaggatgaatcctgggttccagtatgtgattaactacttcctctatagttatttttgattcaattaaatttattttattt

SEQ ID NO: 2775 - DNA, 736 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttattttatttaataagttcaagaaaaaatggaatctttatacttcagataaagctgttcttgaacattttttttcgtcattatcttagttaacc

SEQ ID NO: 2776 - DNA, 681 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaattcggcttttttgtttgtcattggaagttcttttattgattcaatttttatagcgtgttcggaaacgcgtttcagaaaataatgaaatacatcttgaatctgaaagttataacttttagcttcattgtcattgaaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaaatcatggacacattgagaaggatgaatcctgggttccagtatgtgattaactacttcctctatagttatttttgattcaattaaatttatttatttaataagttcaagaaaaaaggaatctttatacttcagataaagctgttacttgaacattttttttgtcattatcttagttaaccgag

SEQ ID NO: 2777 - DNA, 617 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcccttttcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttcttttattaattatatttttattgcgtgtttggaatcccatttgagaaataagaaatcacgtttaaaattgtgaaagttataactattaacttttgactaaacttgaaaaaactcacatttttgatgtggaaccaaatctgatttgagaaccaagttgatttgatggattttgcaggagaattagccacagaactcaccatcaaaagtcatggacacattgagaaggatggaatcctgggttccagtatgtgattaactacttcctctatagtta

SEQ ID NO: 2778 - DNA, 736 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacaagcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttcgtcattatctagttaacc

SEQ ID NO: 2779 - DNA, 484 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtggggcattcctcaattcttgtgccataccatggatggttagttcatcccggcttttttgtttgtcattggaagttcttttattgattcaatttttatagcgtgttcggaaacgcgtttcagaaaactaatgaaatacatcttgaatctgaaaagttataacttttagcttcattgtcattgaaaagttcttttatttaattatatttttgattgcgtgttttggaaatcccattttgagaaataagaaatcacgtttaaaactgtgaaagttataactattaacttttgactaaacttgaaaaaattcacatttttgatgt

SEQ ID NO: 2780 - DNA, 683 bp, Artificial
  Glycine max FAD3A mutation created with TALEN pair GmFAD3_T02.1
  misc_feature (393): n is a or c or t or g
cactgctttgttatgcctacctcatttcatttggctttagacaacttaaatttgagatctttattatgttttttgcttatatggtaaagtgattcattcttcacattgaattgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttcttttattaattatatttttattgcgtgtttggaatcccatttgagaaataagaaatcacgtttaaaatgtgaaagttataactattaacttttgacnaaacttgaaaaaattcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaatggaatctttatacttcagataaagctgttacttgaacattttttttagtcattatcttagttaaccgag

SEQ ID NO: 2781 - DNA, 742 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctgggcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataactttttagcttcattgtcattgaaaagttcttttattaattatatttttattgcgtgtttggaatcccatttgagaaatagaaatcacgtttaaaatgtgaaagttataactattaacttttgactaaacttgaaaaaattcacatttttgatgtggaaccaaatctgatttgagaaccaatgttgatttttgatggattttgcaggagaatttagccacagaactcaccatcaaaatcatggacacattgagaaggtatgaatcctgggttccagtatgtgattaactacttcctctatagttatttttcgattcaattaaatttatttatttaataagttcaagaaaaaagggaatctttatacttcagataaagctgttcttgaacattttttttagtcattatcttagttaaccgagaag

SEQ ID NO: 2782 - DNA, 690 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagtatttttgattcaattaaatttatttatttataagttcaagaaaaatggaatctttatacttcagataaag

SEQ ID NO: 2783 - DNA, 462 bp, Artificial
  Glycine max FAD3A mutation created with TALEN pair GmFAD3_T02.1
cactgctttgttatgcctacctcatttcatttggctttagacaacttaaatttgagatctttattatgtttttttgcttatatggtaaagtgattcattcttcacattgaattgaacagtggccatggaagcttttcagacagcccttttctaaatagcctggtgggacacttgccggtgctgtgccaggcccacggcttgacccggagcaggtggtggccatcgccagcaatggcggtggcaagcaggcgctggagacggtccagcggctgttgccggtgctgtgccaggcccacggctttgaccccggagcaggtggtggccattcgccagcaattcctcaatttcttgtgccatacctatggattggttagttcatcccggcttttttgttgtcattggaagttcttttattgattcaatttttatagcgtgttcggaaacgcgtttcagaaattaatg

SEQ ID NO: 2784 - DNA, 716 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacattcctcaattcttgtgccataccatggatggttagttcatcccggcttttttgtttgtcattggaagttctttttattgattcaatttttatagcgtgttcggaaacgcgtttcagaaaataatgaaaatcatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagtttcaagaaaaaaggaatctttatacttcagataaagctgttcttgaacatttttttttt

SEQ ID NO: 2785 - DNA, 734 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacttgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttattttatttaataagttcaagaaaaaaggaatctttatacttcagataaagctgttcttgaacattttttttgtcattatcttagttaa

SEQ ID NO: 2786 - DNA, 703 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacagcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttattttatttaataagttcaagaaaaatggaatctttatacttcagataaagctgttc

SEQ ID NO: 2787 - DNA, 769 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtggggcacgtactcatgaaggtgtacggctacaggggcaagcattcctcaattcttgtgccataccatggatggttagttcatcccggctttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaagtcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttataagttcaaggaaaaaagggaatctttatacttcagataagctgttcttgaacattttttttagtcattattctagtttaaccga

SEQ ID NO: 2788 - DNA, 706 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacacatggccaccacctgctccggggtcaagccgtgggcctggcacagcaccggcaacagccgctggaccgtctccagcgcctgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttcttttattaattatattttattgcgtgttggaatcccatttgagaaatagaatcacgtttaaatgtgaaagttataactattaactttgactaaacttgaaaaaatcacatttttgatgtggaaaccaaatctgatttgagaaccaagttgattttgatggattttgcaggagaattagccacagaactcaccatcaaaatcatggacacattgagaaggatgaatcctgggttccagtatgtgattaactacttcctctatagttattttt

SEQ ID NO: 2789 - DNA, 706 bp, Artificial
  Glycine max FAD3A mutation created with TALEN pair GmFAD3_T02.1
  misc_feature (541): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacttgccggtgctgtgccaggcccacggcttgaccccggagcaggtggtggccatcgccagcaatggcggtggcaagcaggcgctggagacggtccagcggctgttgccggtgctgtgccaggcccacggcttgaccccggagcaggtggtggccatcgccagcaattcctcaattcttgtgccataccatggatggttagttcatcccggcttttttggtttgtcattggaagttcttttattgattcaatttttatagcgtgttcggaaacgcgtttcagaaaattaatgaaatacatcttgaatctgaaagttataacttttagcttcattgtcattgaaagttcttttattaattatattttattgcgngtttggaatcccatttgagaaataagaaatcacgtttaaaatgtgaaatgttataactattaactttgactaaacttgaaaaatcacatttttgatgtggaaccaaatctgatttgagaaccaagttgattttgatggattttgcaggagaattagccacagaac

SEQ ID NO: 2790 - DNA, 728 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacagcattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaatttatttatttataagttcaagaaaaaggatctttatacttcagataaagctgttcttgaacattttttttcgtcattatcttagtt

SEQ ID NO: 2791 - DNA, 621 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtggccctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaataagaaatcacgtttaaaatgtgaaagttataactattaacttttgactaaacttgaaaaaattcacatttttgatgttggaaccaaatctgatttgagaaccaatgttgattttgatggattttgcaggagaatttagccaacagaactcaccatcaaaatcatggacacattgagaaggatgaatcctgggttccagtatgtgattaactacttcctctatagtta

SEQ ID NO: 2792 - DNA, 640 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaatt

SEQ ID NO: 2793 - DNA, 691 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggtttccagtatgtgattaactacttcctctatagttatttttgattcaattaaatttatttatttaataagttcaagaaaaaggaatctttatacttcagataaagc

SEQ ID NO: 2794 - DNA, 711 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacactcaattcttgtgccataccatggatggttagttcatcccggcttttttgtttgtcattggaagttcttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaaactcaccatcaaaatcatggacacattgagaaggatgaatcctgggttccagtatgtgattaactacttcctctatagttatttttgattcaattaaattatttatttaataagttcaagaaaaaggaatctttatacttcagataaagctgttcttgaacatttttttgtc

SEQ ID NO: 2795 - DNA, 742 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttgtcattatctagttaaccg

SEQ ID NO: 2796 - DNA, 738 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactaacttcctctatagttatttttgatttcaattaaaattttatttattttaataagttcaaagaaaaataggaaaagatctttattacttcagataaaagctgttcttgaacattttttttgtcattatctag

SEQ ID NO: 2797 - DNA, 440 bp, Artificial
  Glycine max FAD3A mutation created with TALEN pair GmFAD3_T02.1
  misc_feature (249): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacattgctggcgatggccaccacctgctccgggggtcaagccgtgggcctggcacagcaccggcaacagcgcctgcaccgnctcttgcattcctcaattcttgtgccataccatggatggttagttcatcccggcttttttgtttgtcatggaagttctttattgattcaatttttatagcgtgttcggaaacgcgtttcagaaaataatgaaatacatcttgaatctgaaagttataacttttagcttcattgtcattgaaagttctttta

SEQ ID NO: 2798 - DNA, 759 bp, Artificial
  Glycine max FAD3A mutation created with TALEN pair GmFAD3_T02.1
  misc_feature (541): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacttgccggtgctgtgccaggcccacggcttgaccccggagcaggtggtggccatcgccagcaatggcggtggcaagcaggcgctggagacggtccagcggctgttgccggtgctgtgccaggcccacggcttgacccggagcaggtggtggccatcgccagcaattcctcaattcttgtgccataccatggatggttagtttcatcccggctttttttgtttgtcattggaagttcttttattgattcaatttttatagcgtgttcggaaacgcgtttcagaaaattaatgaaatacatcttgaatctgaaagttataacttttagcttcattgtcattgaaagttcttttattaattatattttattgcgngtttggaatcccatttgagaaataagaaatcacgtttaaaatgtgaaatgttataactattaactttgactaaacttgaaaaatcacatttttgatgtggaaccaaatctgatttgagaaccaagttgattttgatggattttgcaaggagaattagccacagaactcaccattcaaaatcattggacacattgagaaggatgaatcctgggttccag

SEQ ID NO: 2799 - DNA, 717 bp, Artificial
  Glycine max FAD3A mutation created with TALEN pair GmFAD3_T02.1
cactgctttgttaatgcctacctcatttcatttggctttagacaacttaaatttgagatctttattatgttttttgcttatatggtaaagtgattcattcttcacattgaattgaacagtggccatggaagcttttcagacagcccttttctaaatagcctggtggggcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaatgtgaaagttataactattaacttttgactaaacttgaaaaaattcacatttttgatgtggaaccaaatctgatttgagaaccaagttgattttgatggattttgcaggagaatttagccacagaactcaccatcaaaatcatggacacattgagaaggatgaatcctgggttccagtatgtgattaactacttcctctatagttatttttgattcaattaaatttatttatttaataagttcaagaaaaaagggaatctttatacttcagataaagctgttcttgaacatttttttt

SEQ ID NO: 2800 - DNA, 620 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtggcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaataagaaatcacgtttaaaatgtgaaagttataactattaacttttgactaaacttgaaaaaatcacatttttgatgtggaaccaaatctgatttgagaaccaagttgattttgatggattttgcaggagaatttagccacagaactcaccatcaaaatcatggacacattgagaaggatgaatcctgggttccagtatgtgattaactacttcctctatagtta

SEQ ID NO: 2801 - DNA, 735 bp, Artificial
  Glycine max FAD3A mutation created with TALEN pair GmFAD3_T02.1
  misc_feature (680): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacttgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaatttatttatttataagttcaagaaaaatggaatctttntacttcagataaagctgttcttgaacattttttttcgtcattatctagttaaccg

SEQ ID NO: 2802 - DNA, 639 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacagcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagtatttttgattcaattaa

SEQ ID NO: 2803 - DNA, 669 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggattgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaa

SEQ ID NO: 2804 - DNA, 643 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacactgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaagttataacttttagcttcattgtcattgaaagttcttttattaattatatttttattgcgtgtttggaatcccatttgagaaataagaaatcacgtttaaaatgtgaaatgttataactattaacttttgactaaacttgaaaaaactcacattttgatgtggaaccaaatctgatttgagaaccaagttgattttgatggattttgcaggagaattagccacagaactcaccatcaaaagtcatggacacattgagaaggatgaatcctgggttccagtatgtgattaactacttcctctatagttatttttcgattcaatt

SEQ ID NO: 2805 - DNA, 774 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcaagctttgaatctgattcgagaacttgagatgcagaggatgaaagattcggagacaatcaaagattatgcggacaagcttctcggcattgcaaacaaaatacggcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataactttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttataagttcaagaaaaaagggaatctttatacttcagataaagctgttctttgaacattttttttgtcattattctagtttaaccga

SEQ ID NO: 2806 - DNA, 662 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgaacaggaacttgaactcggtcacgctggaggggtacaccttcctgcattcctcaattcttgtgccataccatggatggttagttcatcccggcttttttgtttgtcattggaagttcttttattgattcaatttttatagcgtgttcggaaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggtatgaatcctgggttccagtatgtgattaactacttcct

SEQ ID NO: 2807 - DNA, 738 bp, Artificial
  Glycine max FAD3A mutation created with TALEN pair GmFAD3_T02.1
  misc_feature (683): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaaatctttntacttcagataaagctgttcttgaacattttttttgtcattatctaagttaaccg

SEQ ID NO: 2808 - DNA, 738 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacaacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaatggaatctttatacttcagataaagctgttcttgaacattttttttcgtcattatcttagttaacctg

SEQ ID NO: 2809 - DNA, 620 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacactattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctct

SEQ ID NO: 2810 - DNA, 683 bp, Artificial
  Glycine max FAD3A mutation created with TALEN pair GmFAD3_T02.1
  misc_feature (242): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaattcggcttttttgtttgtcattggaagttcttttattgattcaatttttatagcgtgttcggaaacgcgtttcagaaaataatgaaanacatcttgaatctgaaagttataactttagcttcattgtcattgaaaagttctttttattaattatatttttattgcgtgtttggaatcccatttgagaaaataagaaaatcacgtttaaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttagtcattatcttagttaaccgag

SEQ ID NO: 2811 - DNA, 742 bp, Artificial
  Glycine max FAD3A mutation created with TALEN pair GmFAD3_T02.1
  misc_feature (687): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacagcattcctcaattcttgtgccataccatggatggttagttcatcccggcttttttgtttgtcattggaagttctttttattgattcaatttttatagcgtgttcggaaacgcgtttcagaaaattaatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaaacttgaaaaaaactcacatttttgatgtggaaccaaatctgatttgagaaccaagttgattttgatggattttgcaggagaattagccacagaactcaccatcaaaagtcatggacacattgagaaggatgaatcctgggttccagtatgtgattaacctacttcctctatagttatttttgattcaattaaatttatttatttaataagttcaagaaaaatggaatctttntacttcagataaagctgttcttgaacattttttttcgtcattatctagttaaccg

SEQ ID NO: 2812 - DNA, 596 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagccctttagacaacttatatttgcattcctcaattcttgtgccataccatggatggttagttcatcccggcttttttgtttgtcattggaagttctttttattgattcaatttttatagcgtgttcggaaaacgcgtttcagaaaataatgaaaatcatctttgaatctgaaagttataacttttagcttcatttgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatgggacacattgagaaggatgaatcctgggttccagtatg

SEQ ID NO: 2813 - DNA, 738 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacactgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttcgtcattatctagttaaccga

SEQ ID NO: 2814 - DNA, 737 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacactgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaagtcatggacacattgagaaggatgaatcctgggttccagtatgtgattaactacttcctctatagttatttttgattcaattaatttatttatttaataagttcaagaaaaatggaatctttatacttcagataaagctgttcttgaacattttttttcgtcattatctagttaaccg

SEQ ID NO: 2815 - DNA, 735 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacagcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatactcagataaagctgttcttgaacattttttttgtcattatctaagttaacc

SEQ ID NO: 2816 - DNA, 655 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacgcccttttctaaatagcctggtgggacacagcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaacctacttcctctatagttatttttgattcaattaaatttatttattt

SEQ ID NO: 2817 - DNA, 737 bp, Artificial
  Glycine max FAD3A mutation created with TALEN pair GmFAD3_T02.1
  misc_feature (692): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagccctttagacaacttatatttgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaactcacatttttgatgtggaaccaaatctgatttgagaaccaagttgattttgatggattttgcaggagaattagccacagaactcaccatcaaaatcatgggacacattgagaaggatgaatcctgggttccagtatgtgattaacctacttcctctatagttatttttgattcaattaaatttattttatttaataagttcaagaaaaaatggaatctttattacttcaganaaagctgttcttgaacatttttttttcgtcattatctagttaacc

SEQ ID NO: 2818 - DNA, 713 bp, Artificial
  Glycine max FAD3A mutation created with TALEN pair GmFAD3_T02.1
  misc_feature (679): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacatattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaatttatttatttataagttcaagaaaaatggaatctttntacttcagataaagctgttctgaacatttttttt

SEQ ID NO: 2819 - DNA, 727 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtggggcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaatgtgaaagttataactattaacttttgactaaacttgaaaaaattcacatttttgatgtggaaccaaatctgatttgagaaccaagttgattttgatggattttgcaggagaatttagccacagaactcaccatcaaaatcatggacacattgagaaggatgaatcctgggttccagtatgtgattaactacttcctctatagttatttttgattcaattaaatttatttatttaataagttcaagaaaaaaggaatctttatacttcagataaagctgttcttgaacatttttttgtcattatcttag

SEQ ID NO: 2820 - DNA, 736 bp, Artificial
  Glycine max FAD3A mutation created with TALEN pair GmFAD3_T02.1
  misc_feature (682): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttntacttcagataaagctgttcttgaacattttttttcgtcattatctagttaacc

SEQ ID NO: 2821 - DNA, 635 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaattgtgaaagttataactattaacttttgactaaacttgaaaaaactcacatttttgatgtggaacccaaaatctgattttgagaaccaagttgattttgatggattttgcaggagaattagccacagaactcaccatcaaaatcatggacacattgagaaggatgaatcctgggttccagtatgtgattaactacttcctctatagttatttttgattcaattaaattta

SEQ ID NO: 2822 - DNA, 812 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatccagcggctgttgccggtgctgtgccaggcccacggcttgaccccggagcaggtggtggccatcgccagctggggggtcaagcaggcgctggagacggtccagcggctgttgccggtgctgtgccaggcccacggcttgacccccagcaggtggtggccatcttgcattcctcaattcttgtgccataccatggatggttagttcatcccggcttttttgtttgtcattggaagttcttttattgatttcaatttttatagcgtgttcggaaacgcgtttcagaaaataatgaaatacatctgaatctgaaagttataacttttagcttcattgtcattgaaagtttcttttattaattatatttttattgcgtgtttggaatcccatttgagaaataagaaattcacgtttaaaatgtgaaagttataactattacttttgactaaacttgaaaaaatcacatttttgatgtggaaccaaattctgatttgagaaccaagttgattttgatggattttgcagggagaattagccacagaacttcaccatcaaaaatcatggacacatttgagaaggatgaatcctgggttccagtatgtgatttaactaacttcctctatagttatttttgattcaatt

SEQ ID NO: 2823 - DNA, 740 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacttgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttcgtcattatcttagttaaccg

SEQ ID NO: 2824 - DNA, 729 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttattttatttaataagttcaagaaaaatggaatctttatacttcagataaagctgttcttgaacattttttttgtcattatct

SEQ ID NO: 2825 - DNA, 710 bp, Artificial; identical to SEQ ID NO: 1561
  Glycine max FAD3A mutation created with TALEN pair GmFAD3_T02.1

SEQ ID NO: 2826 - DNA, 617 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattgagccacagaactcaccatcaaaatcatggacacattgagaaggatgaatccgggttccagtatgtgattaactacttcctctaatag

SEQ ID NO: 2827 - DNA, 739 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacactgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttcgtcattatctagttaaccg

SEQ ID NO: 2828 - DNA, 738 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacagcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaagttataacttttagcttcattgtcattgaaagttcttttattaattatatttttattgcgtgtttggaatcccatttgagaaataagaaatcacgtttaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaacctacttcctctatagttattttttgattccaattaaatttattttatttataaggtttcaagaaaaaggaatctttatacttcagataaagctgttcttgaacattttttttgtcattatcttagttaacc

SEQ ID NO: 2829 - DNA, 735 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacgcattcctcaattcttgtgccataccatggatggttagttcatcccggcttttttgtttgtcattggaagttctttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttattttatttaataagtttcaagaaaaaggaatctttatacttcagataaagctgttcttgaacattttttttgtcattatcttagttaaccg

SEQ ID NO: 2830 - DNA, 717 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacagcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacatttttttt

SEQ ID NO: 2831 - DNA, 559 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacatcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaa

SEQ ID NO: 2832 - DNA, 506 bp, Artificial
  Glycine max FAD3A mutation created with TALEN pair GmFAD3_T02.1
  misc_feature (244); (352): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacttccagcggctgttgccgccatcgtggctggcgatggccaccacctgctccggggtcaagccgtgggcctggcncagcaccggcaacagccgctggaccgtctccagcgcctgcttgccgccattcctcaatttcttgtgccataccatggatggttagttcatcccggcttttttgtttgncattggaagtcttttattgatcaatttttatagcgtgttcggaaacgcgtttcagaaaataatgaatacatcttgaatctgaaagttataacttttagcttcattgtcattgaaagttcttttattaattatatttttattgcgtgtttggaat

SEQ ID NO: 2833 - DNA, 628 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacttcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatccgggttccagtatgtgattaactacttcctctatagttatttttga

SEQ ID NO: 2834 - DNA, 734 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacatgcattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataaagttcaagaaaaaatggaatctttatacttcagataaagctgttcttgaacatttttttgtcattatctagttaacc

SEQ ID NO: 2835 - DNA, 736 bp, Artificial
  Glycine max FAD3A mutation created with TALEN pair GmFAD3_T02.1
  misc_feature (683): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttcgattcaattaaatttatttatttaataagttcaagaaaaatggaatctttntacttcagataaagctgttcttgaacatttttttcgtcattatctagttaacc

SEQ ID NO: 2836 - DNA, 454 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcattcctcaattcttgtgccataccatggatggttagttcatccccgggcttttttggtttgtcattggaagttcttttattgattcaatttttatagcgtgttcggaaacgcgtttcagaaaataatgaaatacatcttgaatctgaaagttataacttttagcttcattgtcattgaaaagttctttttattaaattatattttcattgcgtgtttggaaatcccatttgagaaataagaaatcacgtttaaaaattgtgaaagttataactattaacttttgactaaacttgaaaaaactcacattttt

SEQ ID NO: 2837 - DNA, 684 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacttgcattcctcaattcttgtgccatacccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggatttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttat

SEQ ID NO: 2838 - DNA, 724 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacactcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttcgtcattatctag

SEQ ID NO: 2839 - DNA, 698 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacgttatgacccccgccgatgacggtggagacggtccagcaatattggtggcaagcaggcgctggagacggtccagcggctgttgccggtgctgtgccaggccgcattcctcaattcttgtgccataccatggatggttagttcatcccggcttttttgtttgtcattggaagttcttttattgattcaattttatagcgtgttcggaaacgcgtttcagaaaataatgaaatacatcttgaatctgaaagttataacttttagcttcattgtcattgaaagttcttttattaattatattttattgcgtgttggaatcccatttgagaaataagaaatcacgtttaaaatgtgaaagttataactattaactttgactaaacttgaaaaatcacattttgatgtggaaaccaaatctgatttgagaaccaagttgattttgatggattttgcaggagaattagccacagaactcaccatcaaaatcatggacacaattgagaagggatgaatcctgggattccagtatgtg

SEQ ID NO: 2840 - DNA, 745 bp, Artificial
  Glycine max FAD3A mutation created with TALEN pair GmFAD3_T02.1
  misc_feature (686): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaactcacatttttgatgtggaaccaaatctgatttgagaaccaagttgattttgatggattttgcaggagaattagccacagaactcaccatcaaaagtcatggacacattgagaaggatgaatcctgggttccagtatgtgattaacctacttcctctatagttatttttgattcaattaaatttatttatttaataagttcaagaaaaatggaatctttntacttcagataaagctgttcttgaacattttttttcgtcattatctagttaaccgagaa

SEQ ID NO: 2841 - DNA, 651 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttattt

SEQ ID NO: 2842 - DNA, 605 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcgcctgcttgccaccattattgctggcgatggccaccacctgctggggggtcaagccgtggcctggcacagcaccggcaacagccgctggaccgtctccagctgcctgcttgccaccgccattgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatattttattgcgtgttttggaatcccatttgagaaataagaaaatcacgtttaaaatgtgaaagttataactattaactttgactaaacttgaaaaatcacatttttgatgtggaa

SEQ ID NO: 2843 - DNA, 643 bp, Artificial
  Glycine max FAD3A mutation created with TALEN pair GmFAD3_T02.1
  misc_feature (269): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacaagcattcctcaattcttgtgccataccatggatggttagttcatccccggctttttttgttgcattggaagttctttttattgatcaatttttatagcgngttcggaaacgcgtttcagaaaataatgaaaatacatcttgaatctgaaagttataacttttagcttcattgtcattgaaagttcttttattaattatattttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaa

SEQ ID NO: 2844 - DNA, 586 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagccctttagacaacttatatttgcattcctcaattcttgtgccataccatggatggttagttcatcccggcttttttgttttgtcattggaagttctttttattgattcaatttttatagcgtgttcggaaacgcgtttcagaaaataatgaaaatacatcttgaatctgaaaagttataacttttagcttcattgtcattgaaaagttcttttattaattatatttttatttgcgtgttttggaatcccatttgagaaataagaaaatcacgtttaaaaatgtgaaagttataactattaacttttgactaaaacttgaaaaaaatcacatttttgatgtggaaccaaatctgatttgagaaccaagttgattttgaatggattttgcaggagaattagccacagaaactcaccatcaaaatcatggacacattgagaaggatg

SEQ ID NO: 2845 - DNA, 735 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacattttttttcgtcattatcttagttaaccg

SEQ ID NO: 2846 - DNA, 735 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtcttgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttattttatttaataagttcaagaaaaaggaatctttatacttcagataaagctgttcttgaacattttttttgtcattatctagttaaccgagaa

SEQ ID NO: 2847 - DNA, 737 bp, Artificial
  Glycine max FAD3A mutation created with TALEN pair GmFAD3_T02.1
  misc_feature (683): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaacctacttcctctatagttatttttcgattcaattaaatttatttatttataagttcaagaaaaatggaatctttntacttcagataaagctgttcttgaacattttttttcgtcattatctagttaacc

SEQ ID NO: 2848 - DNA, 799 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcgctggagacggtccagcggctgttgccggtgctgtgccaggcccacggcttgaccccggagcaggtggtggccatcgccagccacgatggcggcaacagccgctggaccattcctcaattcttgtgccataccatggatggttagttcatcccggcttttttgtttgtcattggaagttctttttattgattcaatttttatagcgtgttcggaaacgcgtttcagaaataatgaaatacatcttgaatctgaaagttataacttttagcttcattgtcattgaaagttctttattaattatatttttattgcgtgtttggtaatcccatttgagaaattaagaatcacgtttaaaatgtgaaagttataactattaacttttgactaaatctgaaaaaaactcacattttgtgtggaaccaaatctgattgagaaccaagttgatttgatggattttgcaggagaattagccatcagaactcaccatcaaaatcatggacacattgagaaggatgaatcctgggttccagtatgtgatttaactatcttcctctatagttatttttgattcaattaaatttatttatttaattaagttcaagaaaaatggaatctttatacttcag

SEQ ID NO: 2849 - DNA, 596 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagccctttttctaacacatcttgcattcctcaattcttgtgccataccatggatggttagttcatcccggcttttttgtttgtcattggaagttcttttattgattcaatttttatagcgttgttcggaaacgcgtttcagaaaataatgaaaatacatcatttgaatctgaaaagttataacttttagcttcattgtcattgaaagttcttttattaaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatg

SEQ ID NO: 2850 - DNA, 408 bp, Artificial
  Glycine max FAD3A mutation created with TALEN pair GmFAD3_T02.1
cactgctttgttatgcctacctcatttcatttggctttagacaacttaaatttgagatcttttattatgttttttgcttatatggtaaagtgattcattcttcacattgaattgaacagtggccatggaagcttttcagacagcccttttctaaatagcctggtgggacgcattcctcaaattcttgtgccataccatggatggttagttcatcccggcttttttgtttgtcattggaagttctttttattgattcaatttttatagcgtgttcggaaacgcgtttcagaaaataatgaaaatacatctttgaatctgaaagttataacttttagcttcatttgtcattgaaagttctttttattaatatatttttattgcgtgtttggaatcccatttgagaaataa

SEQ ID NO: 2851 - DNA, 746 bp, Artificial
  Glycine max FAD3A mutation created with TALEN pair GmFAD3_T02.1
  misc_feature (690): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacactattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattcaatttaattttatttaattaaagtttcaagaaaataggaaagtctttntaacttcagataaagctgttcttgaacattttttttcgtcattatcttagttaacc

SEQ ID NO: 2852 - DNA, 380 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatccagcgcctgcttgccaccattattgctggcgatggccaccacctgctggggggtcaagccgtgggcctggcacagcaccggcaacagcgcctgcaccgtctccagcgcctgcttgccaccaatattgctggcgatggccaccacctgctccggggtcaagccgtgggcctggcacattcctcaattcttgtgccataccatggatgg

SEQ ID NO: 2853 - DNA, 737 bp, Artificial; identical to SEQ ID NO: 1997
  Glycine max FAD3A mutation created with TALEN pair GmFAD3_T02.1

SEQ ID NO: 2854 - DNA, 697 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatattttattgcgtgtttggaatcccatttgagaaataagaaatcacgtttaaaattgtgaaagttataactattaacttttgactaaacttgaaaaaatcacatttttgatgtggaaccaaatctgatttgagaaccaagttgaattttgatggattttgcaggagaattagccacagaactcaccatcaaaatcatggacacattgagaaggatgaatcctgggttccagtatgtgattaactacttcctctatagttatttttggattccaattaaatttatttatttaataagttcaagaaaaaagggaatctttatacttcagataaagctgttcttgaacattttttt

SEQ ID NO: 2855 - DNA, 730 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacagcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttcgtcattatctagt

SEQ ID NO: 2856 - DNA, 736 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttcagtatgtgattaacctacttcctctatagttatttttgattcaattaaatttattttatttaataagttcaagaaaaaaaggaatctttatacttcagataaagctgttcttgaacattttttttcgtcattatcttagttaaccg

SEQ ID NO: 2857 - DNA, 712 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaagttcttttattaattatatttttattgcgtgtttggaatcccatttgagaaataagaaatcacgtttaaaaatgtgaaagttataactattaacttttgactaaacttgaaaaaattcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaagggaatctttatacttcagataaagctgttcttgaacattttttt

SEQ ID NO: 2858 - DNA, 656 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtcttgcattcctcaattcttgtgccataccatggatggttagttcatcccggcttttttcgttttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttttgattcaattaaatttattttatttaat

SEQ ID NO: 2859 - DNA, 719 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattacggcttgaccccggagcaggtggtggccatcgccagcaatattggtggcaagcaggcgctggagacggtgcaggcgctgttgccggtgctgtgccattatcttattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaatgtgaaagttataactattaacttttgactaaacttgaaaaaattcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaagggaatctttatacttcagataaagctgttcttgaacatttttttagtcattatcttagttaaccgag

SEQ ID NO: 2860 - DNA, 713 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcagcaccggcaacagccgctggaccgtctccagcgcctgcttgccaccattattgctggcgatggccaccacctgctggggggtcaagccgtgggcctggttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttcttttattaattatattttattgcgtgttggaatcccatttgagaaataagaaatcacgtttaaaatgtgaaagttataactattaacttttgactaaacttgaaaaaaatcacattttgatgtggaaaccaaatctgatttgagaaccaagttgattttgatggattttgcaggagaattagccacagaactcaccatcaaaatcatggacacattgagaaggatgaatcctgggattccagtatgtgattaact

SEQ ID NO: 2861 - DNA, 655 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgagaagttggcctgtgtccaactgtaacggtggacctctcaactctcccgccaccgtgagcaagtgcattcctcaattcttgtgccataccatggatggttagttcatcccggcttttttgttttgtcattggaagttcttttatttgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaatcacattttgatgtggaaccaaatctgatttgagaaccaagttgattttgatggattttgcaggagaattagccacagaactcaccatcaaaatcatggacacaattgagaaagggatg

SEQ ID NO: 2862 - DNA, 737 bp, Artificial
  Glycine max FAD3A mutation created with TALEN pair GmFAD3_T02.1
  misc_feature (683): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacagcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttntacttcagataaagctgttcttgaacattttttttcgtcattatctagttaacc

SEQ ID NO: 2863 - DNA, 740 bp, Artificial
  Glycine max FAD3A mutation created with TALEN pair GmFAD3_T02.1
  misc_feature (251); (685): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggattgcattcctcaattcttgtgccataccatggatggttagttcatcccggcttttttgtttgtcattggaagttcttttattgnttcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaactcacatttttgatgtggaaccaaatctgatttgagaaccaagttgattttgatggattttgcaggagaattagccacagaactcaccatcaaaatcatggacacattgagaaggatgaatcctgggttccagtcatgtgattaactacttcctctatcagttatttttgattcaattaaatttatttatttaataagttcaagaaaatggaaaatctttntacttcagataaagctgttcttgaacattttttttcgtcattatctagttaaccg

SEQ ID NO: 2864 - DNA, 735 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctgggcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttctttattaattatatttttattgcgtgtttggaatcccatttgagaaataagaaatcacgtttaaaatgtgaagttataactattaacttttgactaaacttgaaaaaattcacatttttgatgtggaaccaaatctgatttgagaaccaagttgattttgatggattttgcaggagaatttagccacagaactcaccatcaaaatcatggacacattgagaaggatgaatcctgggttccagtatgtgattaactacttcctctatagttattttgattcaattaaatttatttatttaataagttcaagaaaaaagggaatctttatacttcagataaagctgattcttgaacatttttttagtcattatcttagttaaccgagaag

SEQ ID NO: 2865 - DNA, 736 bp, Artificial
  Glycine max FAD3A mutation created with TALEN pair GmFAD3_T02.1
tactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggactgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacattttttttcgtcattatcttagttaaccg

SEQ ID NO: 2866 - DNA, 816 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatgctggcgatggccaccacctgctggggggtcaagccgtgggcctggcacagcaccggcaacagcgcctgcaccgtctccagcgcctgcttttcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatattttattgcgtgtttggaatcccatttgagaaataagaaatcacgtttaaaatgtgaagttataactattaactttagaactaaactttgaaaaaatcacatttttgatgtggaaccaaatctgatttgagaaccaagttgattttgatggattttgcaggagaattagccacagaactcaccatcaaaatcatggacacaattgagaaggatgaatcctgggttccagtatgtgattaactacttcctctatagttattttttgattcaattaattttatttatttaataagttcaagaaaaaggaatctttatactttcagataaagctgttcttgaaacatttttttcgtcattatc

SEQ ID NO: 2867 - DNA, 687 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatgcttgcattcctcaattcttgtgccataccatggatggttagttcatcccggcttttttgtttgtcattggaagttcttttattgattcaatttttatagcgtgttcggaaacgcgtttcagaaataatgaaatacatcttgaatctgaaagttataacttttagcttcattgtcattgaaagttcttttattaattatatttttattgcgtgtttggaatcccatttgagaaatagaaatcacgtttaaaatgtgaaagttataactattaacttttgactaaacttgaaaaaatcacatttttgatgtggaaccaaatctgatttgagaaccaagttgattttgatggatttttgcaggagaattagccacagaactcaccatcaaaaatcatggacacattgagaaggatgaatcctgggttccagtatgtgattaactacttcctctatagttatttttgattcaattaaatttatttatttaataagttcaagaaaaaaggaatctttatacttcagataaagctgttcttgaacattttttttgtcattatcttag

SEQ ID NO: 2868 - DNA, 697 bp, Artificial
  Glycine max FAD3A mutation created with TALEN pair GmFAD3_T02.1
  misc_feature (356): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacactggcgacaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgcattcctcaattcttgngccataccatggatggttagttcatcccggcttttttgttgtcattggaattctttatgattcaatttttatagcgtgttcggaaatcgcgtttcagaaaataatgaaatacatcttgaatctgaaagttataacttttagcttcattgtcattgaaagtttcttttattaattatatttttattgcgtgtttggaatcccatttgagaaataagaaattcacgtttaaaatgtgaaagttataactattaacttttgactaaacttgaaaaaatcacatttttgatgtggaaccaaatctgatttgagaaccaagttgattttgatggattttgcaggag

SEQ ID NO: 2869 - DNA, 737 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacagcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttcgtcattatctagttaacc

SEQ ID NO: 2870 - DNA, 495 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcccttttcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatattttattgcgtgtttggaatcccatttgagaataagaaatcacgtttaaaatgtgaaagttataactattaacttttgactaaaacttgaaaaaatcacatttttgatgtggaaccaaattctgattttgagaaccaag

SEQ ID NO: 2871 - DNA, 738 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacttgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttattttatttaataagttcaagaaaaatggaatctttatacttcagataaagctgttcttgaacatttttttttcgtcattatctagttaacc

SEQ ID NO: 2872 - DNA, 734 bp, Artificial
  Glycine max FAD3A mutation created with TALEN pair GmFAD3_T02.1
  misc_feature (680): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacagcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaatttatttatttataagttcaagaaaaatggaatctttntacttcagataaagctgttcttgaacattttttttcgtcattatctagttaacc

SEQ ID NO: 2873 - DNA, 738 bp, Artificial
  Glycine max FAD3A mutation created with TALEN pair GmFAD3_T02.1
  misc_feature (683): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacattgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactactcctctatagttatttttgattcaattaaatttatttatttaataagttcaagaaaaatggaatctttntacttcagataaagctgttcttgaacattttttttgtcattatctaagttaaccg

SEQ ID NO: 2874 - DNA, 716 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacatttttttt

SEQ ID NO: 2875 - DNA, 736 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacaccgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttcgtcattatctagttaaccg

SEQ ID NO: 2876 - DNA, 603 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttcaaacactcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttcttttattaattatatttttattgcgtgtttggaatcccatttgagaaataagaaatcacgtttaaatgtgaaagttataactattaacttttgactaaacttgaaaaaatcacatttttgatgtggaaccaaatctgattttgagaaccaagttgattttgatggattttgcaggagaattagccacaagaactcaccatcaaaatcatggacacattgagaaggattgaatcctgggttccagtatgtgattaactacttcctctatag

SEQ ID NO: 2877 - DNA, 739 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttcgtcattatctagttaaccg

SEQ ID NO: 2878 - DNA, 732 bp, Artificial
  Glycine max FAD3A mutation created with TALEN pair GmFAD3_T02.1
  misc_feature (678): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaatttatttatttataagttcaagaaaatggaatctttntacttcagataaagctgttcttgaacatttttttcgtcattatctagttaaccg

SEQ ID NO: 2879 - DNA, 586 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaagt

SEQ ID NO: 2880 - DNA, 735 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacagttgccggtgctgtgccaggcccacggcttgacccccacgacaggtggtggccatcgccagcaatggcggtggcaagcaggcgctggagacggtccagcggctgttgccggtgctgtgccaggcccacggcttgaccccggagcattcctcaattcttgtgccataccatggatggttagttcatcccggcttttttgtttgtcattggaagttcttttattgattcaatttttatagcgtgttcggaaacgcgtttcagaaaataatgaatacatcttgaatctgaaagttataacttttagcttcattgtcattgaaagttcttttattaattatattttattgcgtgtttggaatcccatttgagaatagaatcacgttaaatgtgaagttataactattaactttgactaaacttgaaaaactcacatttttgatgtggaaccaaatctgatttgagaaccaagttgatttttgatggattttgcaggagaattagccacagaactcaccatcaaatcatggacacattgagaaggatgaatcctgggttccagtatgtg

SEQ ID NO: 2881 - DNA, 737 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaaatgtgaaagttataactattaacttttgactaaacttgaaaaaattcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaagggaatctttatacttcagataaagctgttcttgaacattttttttagtcattatcttagttaaccgag

SEQ ID NO: 2882 - DNA, 637 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggagcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaatt

SEQ ID NO: 2883 - DNA, 617 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtggggcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaatagaatcacgtttaaatgtgaagttataactattaacttttgactaaacttgaaaaaatcacatttttgatgtggaaccaaatctgattgagaaccaagttgattttgatggattttgcaggagaatttagccacagaactcaccatcaaaatcatggacacattgagaaggatgaatcctgggttccagtatgtgattaactacttcctctatagtta

SEQ ID NO: 2884 - DNA, 721 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcgctggagacggtccagcggctgttgccggtgctgtgccaggcccacggcttgaccccggagcaggtggtggccatcgccagccacgatggcggcaacagccgctggaccattcctcaattcttgtgccataccatggatggttagttcatcccgggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgttaaaatgtgaaagttataactattaacttttgactaaatcttgaaaaaaactcacatttttgtgtgggaccaaattctgattgagaaccaagttgattttgatggatttttgcaggagaattagccacagaactcaccatcaaaatcatggacacattgagaaggtatgaatcctgggttccagtatgtgattaact

SEQ ID NO: 2885 - DNA, 742 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtcttgcattcctcaattcttgtgccataccatggatggtagttcatcccggcttttttcgttttgtcattggaagttcttttatgattcaatttttatagcgttgttcggaaaacgcgtttcagaaaataatgaaaatacatcattgaatctgaaagttataacttttagtcttcattgtcattgaaagttcttttattaattatatttttattgcgtgtttggaatcccatttgagaaataagaaatcacgtttaaaaatgtgaaagttataactattaacttttgactaaacttgaaaaaaatcacatttttgatgtggaaccaaatctgatttgagaaccaagttgattttgatggattttgcaggagaattagccacagaaactcaccatcaaaatcatggacacattgagaaggatgaatcctgggttccagtatgtgattaactaacttcctctatagttatttttgattcaattaaatttatttatttaataagttcaagaaaaatggaaatctttatacttcagataaaagctgttcttgaacatttttttttgtcattatctagttaaccg

SEQ ID NO: 2886 - DNA, 640 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtggggcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaataagaaatcacgtttaaatgtgaagttataactattaacttttgactaaacttgaaaaaatcacatttttgatgtggaaccaaatctgatttgagaaccaagttgattttgatggattttgcaggagaatttagccacagaactcaccatcaaaatcatggacacattgagaaggatgaatcctgggttccagtatgtgattaactacttcctctatagttattttgattcaattaaattta

SEQ ID NO: 2887 - DNA, 719 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacagcgcctgcttgccgccatcgtggctggcgatggccaccacctgctccggggtcaagccgtgggcctggcacagcaccggcaacagccgctggattcctcaattcttgtgccataccatggatggttagttcatcccggcttttttgtttgtcattggaagttctttttattgattcaatttttatagcgtgttcggaaacgcgtttcagaaaataatgaaatacatcttgaatctgaaagttataacttttagcttcattgtcattgaaagttcttttattaattatattttattgcgtgttggaatcccatttgagaaataagaatcacgtttaaaatgtgaaagttataactattaactttgactaaacttgaaaaaatcacatttttgatgtggaaccaaatctgatttgagaaccaagttgattttgatggattttgcaggagaattagccacagaactcaccatcaaaatcatggacacattgagaagggatgaatcctgggttccagtatgtgattaactacttcctctatagttatttttt

SEQ ID NO: 2888 - DNA, 735 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaattcatggacacattgagaaggatgaatcctgggttccagtatgtgattaactacttcctctatagttatttttgattcaattaaatttatttatttaataagttcaagaaaaaggaatctttatacttcagataaagctgttcttgaacattttttttcgtcattatcttagttaaccg

SEQ ID NO: 2889 - DNA, 723 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacactcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacattttttttcgtcattatctt

SEQ ID NO: 2890 - DNA, 711 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaaggaatctttatacttcagataaagctgttcttgaacatttttttt

SEQ ID NO: 2891 - DNA, 711 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggactcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaataagaaatcacgtttaaaatgtgaaagttataactattaacttttgactaaacttgaaaaaattcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaagggaatctttatacttcagataaagctgttcttgaacattttttt

SEQ ID NO: 2892 - DNA, 647 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggctttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaatttatatttttatttgcgtgtttggaatcccatttgagaaataagaaatcacgtttaaaatgtgaaagttataactattaacttttgactaaacttgaaaaaaactcacatttttgatgtggaaccaaatctgatttgagaaccaagttgattttgatggattttgcaggagaattagccacagaactcaccatcaaaagtcatggacacattgagaaggatgaatcctgggttccattatgtgattaacctacttcctctatagttatttttgattcaatt

SEQ ID NO: 2893 - DNA, 626 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagccttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaagttcttttattaattatatttttattgcgtgtttggaatcccatttgagaataagaaatcacgtttaaatgtgaagttataactattaacttttgactaaacttgaaaaaattcacatttttgatgtggaaccaaatctgatttgagaccaagttgattttgatggattttgcaggagaattagccacagaactcaccatcaaaatcatggacacattgagaaggatgaatcctgggttccagtatgtgattaactacttcctctatagttatttttcgattcaa

SEQ ID NO: 2894 - DNA, 714 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtggcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaatgtgaaagttataactattaacttttgactaaacttgaaaaaattcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaaagggaatctttatacttcagataaagctgttcttgaacatttttttt

SEQ ID NO: 2895 - DNA, 606 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacaacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaa

SEQ ID NO: 2896 - DNA, 666 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacattcctcaattcttgtgccataccatggatggttagttcatcccggcttttttgtttgtcattggaagttcttttattgattcaatttttatagcgtgttcggaaacgcgtttcagaaaataatgaaaatcatcttgaatctgaaagttataacttttagctcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaacctacttcctctatagttatttttgattcaattaaatttatttatttataagttcaagaaaaa

SEQ ID NO: 2897 - DNA, 733 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaatgtgaaagttataactattaacttttgactaaacttgaaaaaattcacatttttgatgtggaaccaaatctgatttgagaaccaagttgattttgatggattttgcaggagaattagccacagaactcaccatcaaaattcatggacacattgagaaggatgaatcctgggttccagtatgtgattaactacttcctctatagttatttttgattcaattaaatttatttatttaataagttcaagaaaaaagggaatctttatacttcagataaagctgattcttgaacatttttttagtcattatcttagttaaccgag

SEQ ID NO: 2898 - DNA, 729 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacagcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagtttcaagaaaaatggaatctttatacttcagataaagctgttcttgaacattttttttcgtcattatct

SEQ ID NO: 2899 - DNA, 690 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaatcacattttgatgtggaaccaaatctgatttgagaaccaagttgattttgatggattttgcaggagaattagccacagaactcaccatcaaaatcatggacaacattgagaaggatgaatcctgggttccagtatgtgattaactacttcctctatagttatttttgattcaattaaatttatttatttaataagttcaagaaaaaggaatctttatacttcag

SEQ ID NO: 2900 - DNA, 644 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaattgtgaaagttataactattaacttttgactaaacttgaaaaaactcacattttgatgtggaaccaaatctgatttgagaaccaagttgattttgatggattttgcaggagaattagccacagaactcaccatcaaaagtcatggacacattgagaaggatgaatcctgggttccagtatgtgattaactacttcctctatagttatttttgattcaatt

SEQ ID NO: 2901 - DNA, 739 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacactgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaagtcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttcgtcattatctagttaaccg

SEQ ID NO: 2902 - DNA, 606 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacatcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaagttataactattacttttgactaaacttgaaaaatcacattttgatgtggaaccaaatctgatttgagaaccaagttgattttgatggattttgcaggatgaattgagccacagaacttcaccatcaaaatcatggacacattgagaaggatgaatcctgggttccagtatgtgattaa

SEQ ID NO: 2903 - DNA, 647 bp, Artificial
  Glycine max FAD3A mutation created with TALEN pair GmFAD3_T02.1
  misc_feature (249): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacattcctcaattcttgtgccataccatggatggttagttcatcccggcttttttgtttgtcattggaagttctttttattgnttcaatttttatagcgtgttcggaaacgcgtttcagaaaattaatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaaacttgaaaaaaactcacatttttgatgtggaaccaaatctgatttgagaaccaagttgattttgatggattttgcaggagaattagccacagaactcaccatcaaaagtcatggacacattgagaaggatgaatcctgggttccagtatgtgattaactacttcctctatagttatttttgattcaattaattta

SEQ ID NO: 2904 - DNA, 738 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctgttcttgaacattttttttcgtcattatcttagttaaccg

SEQ ID NO: 2905 - DNA, 732 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggactcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaataagaaatcacgtttaaaatgtgaaagttataactattaacttttgactaaacttgaaaaaattcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttcgattcaattaaatttatttattaataagttcaagaaaaaagggaatcttatacttcagataaagctgttcttgaacatttttttagtcattatcttagttaaccgag

SEQ ID NO: 2906 - DNA, 593 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagcattcctcaattcttgtgccatatcatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttctttttattaattatattttattgcgtgtttggaatcccatttgagaataagaaatcacgtttaaaattgtgaaagttataactattaacttttgactaaacttgaaaaaactcacatttttgatgtggaaccaaatctgattttgagaaccaagttgattttgatggattttgcaggagaattagccacagaactcaccatcaaaatcatggacacattgagaaggatgaatcctgggttccagtatgtgattaactacttcctctatagtta

SEQ ID NO: 2907 - DNA, 733 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaataagaaatcacgtttaaaatgtgaaagttataactattaacttttgactaaacttgaaaaaattcacatttttgatgtggaaccaatctgatttgagaaccaagttgattttgattggattttgcaggagaatttagccacagaactcaccatcaaaatcatggacacattgagaaggatgaatcctgggttccagtatgtgattaactacttcctctatagttatttttgattcaattaaatttatttatttaataagttcaagaaaaaaggaatctttatacttcagataaagctgttcttgaacattttttttgtcattatcttagttaaccgag

SEQ ID NO: 2908 - DNA, 737 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttcgtcattatctagttaacc

SEQ ID NO: 2909 - DNA, 697 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtggattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaaagggaatctttatacttcagataaagctgttc

SEQ ID NO: 2910 - DNA, 641 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaaacttcaccatcaaaatcatggacacattgagaaggatgaatcctgggttccagtatgtgattaactacttcctctatagttatttttgattcaatt

SEQ ID NO: 2911 - DNA, 733 bp, Artificial
  Glycine max FAD3A mutation created with TALEN pair GmFAD3_T02.1
  misc_feature (679): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacagcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaacctacttcctctatagttatttttgattcaattaatttatttatttataagttcaagaaaatggatctttntacttcagataaagctgttcttgaacattttttttcgtcattatctagttaacc

SEQ ID NO: 2912 - DNA, 534 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggatgcattcctcaattcttgtgccataccatggatggttagttcatcccggcttttttcgtttgtcattggaagttcttttattgattcaatttttatagcgtgttcggaaacgcgtttcagaaaattaatgaaaatacatcttgaatctgaaagttataacttttagcttcattgtcattgaaagttcttttattaattatatttttattgcgtgtttggaatcccatttgagaaataagaaatcacgtttaaaattgtgaaagttataactattaacttttgactaaacttgaaaaaactcacattttgatgtggaaccaaattctgattgagaaccaagttgattttgatggattttgcaggagaa

SEQ ID NO: 2913 - DNA, 665 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggactcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaataagaaatcacgtttaaaatgtgaaagttataactattaacttttgactaaacttgaaaaaattcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaa

SEQ ID NO: 2914 - DNA, 741 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttcgtcattatctagttaaccgagaa

SEQ ID NO: 2915 - DNA, 733 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacattgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagaataaagctgttcttgaacatttttttcgtcattatctagtt

SEQ ID NO: 2916 - DNA, 738 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggattgcattcctcaattcttgtgccataccatggatggttagttcatcccggcttttttgttttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagtttcaagaaaaaaggaatctttatacttcagataaagctgttcttgaacattttttttgtcattatcttagttaaccg

SEQ ID NO: 2917 - DNA, 719 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggagcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaatttatttatttaataagttcaagaaaaaggaatctatacttcagataaagctgttctttgaacatttttttttcgtcatt

SEQ ID NO: 2918 - DNA, 717 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataactttttagcttcatttgtcattgaaaagttctttttattaattatatttttattgcgtgtttggaatcccatttgagaaataagaaatcacgtttaaaaatgtgaaagttataactattaacttttgactaaacttgaaaaaactcacatttttgatgtggaaccaaatctgattttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaagggaatctttatacttcagataaagctgttcttgaacatttttttagtcattatcttagttaaccgag

SEQ ID NO: 2919 - DNA, 585 bp, Artificial
  Glycine max FAD3A mutation created with TALEN pair GmFAD3_T02.1
  misc_feature (529): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacagcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaagttataactattaacttttgactaaacttgaaaaaatcacattttgatgtggaaccaaatctgatttgagaaccaagttgattttgatggattttgcaggngaattagccacagaactcaccatcaaaatcatggacacattgagaaggatgaatcc

SEQ ID NO: 2920 - DNA, 590 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacagcaccggcaacagcgcctgcaccgtctccagcgcctgcttgccaccaatattgctggcgatggccaccacctgctccggggtcaagccgtgggcctggcacagcaccggcaacagccgctggaccgtctcgcattcctcaattcttgtgccataccatggatggttagttcatcccggctttttgtttgtcattggaagttcttttattgattcaatttttatagcgtgttcggaaacgcgtttcagaaaataatgaatacatcttgaatctgaaagttataacttttagcttcattgtcattgaagttcttttattaattatatttttattgcgtgtttggaatcccatttgagaaataagaatcacgtttaaatgtgaaagttataactattaacttttgactaaacttgaaaaaaa

SEQ ID NO: 2921 - DNA, 662 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacactattgctggcgatggccaccacctgctccggggtcaagccgtgggcctggcacagcaccggcaacagcgcctggaccgtctccagcgcctgcttgccaccaactcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgttggaatcccatttgagaaataagaaatcacgtttaaaatgtgaaagttataactattaactttgactaaacttgaaaaaatcacatttttgatgtggaaccaaatctgatttgagaaccaagttgaattttgatggattttgcaggagaaattagccacagaactcaccatcaaaatcatggaca

SEQ ID NO: 2922 - DNA, 732 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacagcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgaattaactacttcctctatagttatttttgattcaattaaatttatttatttaataagttcaagaaaaatggaatctttatacttcagataaagctgttcttgaacattttttttgtcattatctagtt

SEQ ID NO: 2923 - DNA, 568 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacaattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacaca

SEQ ID NO: 2924 - DNA, 692 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacattcctcaattcttgtgccataccatggatggttagttcatcccggcttttttgtttgtcattggaagttctttttattgattcaatttttatagcgtgttcggaaacgcgtttcagaaaataatgaaaatacatctgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaatcacatttttgatgtggaaccaaaatctgatttgagaaccaagttgattttgatggattttgcaggagaattagccacagaaactcaccatcaaaatcatggacacattgagaaggatgaatcctgggttccagtatgtgattaactacttcctctatagtatttttgattcaattaaatttatttatttaataagttcaagaaaaatggaaatctttataacttcaga

SEQ ID NO: 2925 - DNA, 736 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacagcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttcgtcattatctagttaacc

SEQ ID NO: 2926 - DNA, 717 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaaatgtgaaagttataactattaacttttgactaaacttgaaaaaattcacatttttgatgtggaaccaaatctgatttgagaaccaagttgatttttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaaagggaatctttatacttcagataaagctgttcttgaacatttttttt

SEQ ID NO: 2927 - DNA, 614 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacattcctcaattcttgtgtcataccatggatggttagttcatcccggcttttttgtttgtcattggaagttctttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaacctacttcc

SEQ ID NO: 2928 - DNA, 734 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcgctggaccgtctccagcgcctgcttgccaccattattgctggcgatggccaccacctgctggggggtcaagccgtgggcctggcacagcaccggcaacagccgctttgcattcctcaattcttgtgccataccatggatggttagttcatcccggcttttttgtttgtcattggaagttcttttattgattcaatttttatagcgtgttcggaaacgcgtttcagaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaactttgactaaacttgaaaaaagtcacatttttgatgtggaaaccaaatctgatttgagaaccaagttgattttgatggattttgcaggagaattagccacagaactcaccatcaaaatcatggacacattgagaagggatgaatcctgggttccagtatgtgattaactacttcctctatagtt

SEQ ID NO: 2929 - DNA, 735 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacagcattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaaatctttatacttcagataaagctgttcttgaacatttttttgtcattatcttagttaaccg

SEQ ID NO: 2930 - DNA, 726 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgtcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaataagaaatcacgtttaaaatgtgaaagttataactattaacttttgactaaacttgaaaaaatcacatttttgatgtggaaccaaatctgattgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaaaggaatctttatacttcagataaagctgattcttgaacatttttttgtcattatcttagttaaccgag

SEQ ID NO: 2931 - DNA, 675 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcgatggccaccacctgctccggggtcaagccgtgggcctggcacagcaccggcaacagccgctggaccgtctccagcgcctgcttgccaccattattgctggcgatggccaccttgcattcctcaattcttgtgccataccatggatggttagttcatcccggctttttgtttgtcattggaagttcttttattgattcaatttttatagcgtgttcggaaacgcgtttcagaaataatgaaatacatcttgaatctgaaagttatacttttagcttcattgtcattgaaagttctttattaattatatttttattgcgtgtttggaatcccatttgagaaataagaaatcacgtttaaaatgtgaaagttataactattaacttttgactaaacttgaaaaaaactcacatttttgatgtggaaccaaaattctgatttgagaaccaagttgattttgatggattttgcaggagaattagccacagaactcaccatcaaaatcatggacacattgag

SEQ ID NO: 2932 - DNA, 492 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacttcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcaacattttgattgtggaaccaaatctga

SEQ ID NO: 2933 - DNA, 686 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgaccccggagcaggtggtggccatcgccagccacgatggcggcaagcaggcgctggagacggtccagcggctgttgccggtgctgtgccaggcccacggcttgaccccggacttgcattcctcaattcttgtgccataccatggatggttagttcatcccggcttttttgtttgtcattggaagttcttttattgattcaatttttatagcgtgttcggaaacgcgtttcagaaaataatgaaatacatcttgaaatctgaaagttataacttttagcttcattgtcattgaaaagttcttttattaattatattttattgcgtgtttggaatccccatttgagaaataagaaatcacgtttaaaatgtgaaagttataactattaactttgactaaacttgaaaaaaatcacatttttgtgtggaaaccaaatctgatttgagaaccaagttagattttgatggattttgcaggagaaattagccacagaactcaccatcaaaatcatgg

SEQ ID NO: 2934 - DNA, 736 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggagcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaacctacttcctctatagttatttttgattcaattaaatttatttatttaataagttcaagaaaaaaggaatctttatacttcagataaagctgttcttgaacattttttttgtcattatcttagttaaccg

SEQ ID NO: 2935 - DNA, 740 bp, Artificial
  Glycine max FAD3A mutation created with TALEN pair GmFAD3_T02.1
  misc_feature (685): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacaccgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttntacttcagataaagctgttcttgaacattttttttcgtcattatctagttaaccg

SEQ ID NO: 2936 - DNA, 702 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacttcctcaattcttgtgccataccatggatggttagttcatcccggctttttttcgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacatttttgatgtggaaccaaattctgatttgagaaccaagttgattttgatggattttgcaggagaattagccacagaactcaccatcaaaatcatggacacattgagaaggatgaatcctgggttccagtatgtgattaacctacttcctctatagttatttttgattcaattaatttatttatttataagttcaagaaaaatggaatctttatacttcagataaagctgttc

SEQ ID NO: 2937 - DNA, 737 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaaattatatttttattgcgtgtttggaatcccatttgagaaataagaaatcacgtttaaaatgtgaaagttataactattaacttttgactaaacttgaaaaaatcacatttttgatgtggaaccaaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaaatctttatacttcagataaagctgttcttgaacattttttttgtcattatctagttaaccg

SEQ ID NO: 2938 - DNA, 484 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggactcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaaagttataacttttagcttcaattgtcattgaaaagttcttttattaattatatttttattgcgtgtttggaaatcccatttgagaaattaagaaatcacgtttaaaaatgtgaaagttataactattaacttttgactaaaacttgaaaaaaatcacaatttttgatgtt

SEQ ID NO: 2939 - DNA, 655 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattccttcacattgaattgaacagtggccatggaagcttttcagacagcccttttctaaatagcctggtgggacacgcattcctcaaattcttgtgccataccatgggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaaagttcttttattaattatatttttatttgcgtgtttggaatcccatttgagaaataagaaatcacgtttaaaatgtgaaagttataactattaacttttgactaaacttgaaaaaactcacatttttgatgtggaaccaaatctgatttgagaaccaagttgattttgatggattttgcaggagaattagccacagaactcaccatcaaaagtcatggacacattgagaaggatgaatcctgggttccagtatgtgattaacctacttcctctatagttatttttgattcaattaaattta

SEQ ID NO: 2940 - DNA, 737 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggaattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaatgtgaaagttataactattaacttttgactaaacttgaaaaaattcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttcgattcaattaaatttatttatttaataagttcaagaaaaaagggaatctttatacttcagataaagctgttcttgaacatttttttagtcattatcttagttaaccgag

SEQ ID NO: 2941 - DNA, 588 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatctgttgccggtgctgtgccaggcccacggcttgaccccccagcaggtggtggccatcgccagcaataatggtggcaagcaggcgctggagacggtccagcggcttgcattcctcaattcttgtgccataccatggatggttagttcatcccggcttttttgtttgtcattggaagttctttttattgattcaatttttatagcgtgttcggaaacgcgtttcagaaaataatgaaatacatcttgaatctgaaagttataacttttagcttcattgtcattgaaagttcttttattaattatattttcattgcgtgtttggaatccccatttgagaaataagaaatcacgtttaaatgtgaaagttataactattaactttgactaaacttgaaaaaagtcacatttttgatgtgg

SEQ ID NO: 2942 - DNA, 736 bp, Artificial; identical to SEQ ID NO: 1652
  Glycine max FAD3A mutation created with TALEN pair GmFAD3_T02.1

SEQ ID NO: 2943 - DNA, 599 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacagcaccggcaaacagcgcctgcaccgtctccagcgcctgcttgccaccaatattgctggcgatggccaccacctgctccggggtcaagccgtgggcctggcacagcaccggcaacagccgctggaccgtctcgcattcctcaattcttgtgccataccatggatggttagttcatcccggctttttgtttgtcattggaagttcttttattgatcaatttttatagcgtgttcggaaacgcgtttcagaaaataatgaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaactcaca

SEQ ID NO: 2944 - DNA, 695 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacaatcattcctcaattcttgtgccataccatggatggttagttcatcccggctttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgacttaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaataggaatctttatacttcaga

SEQ ID NO: 2945 - DNA, 613 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggaccttgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgaatggattttgcaggagaattagccacagaactcaccatcaaaatcatggacacattgagaaggatgaatcctgggttccagtatgtgattaactac

SEQ ID NO: 2946 - DNA, 745 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaacctacttcctctatagttatttttgattcaattaaatttattttatttaataagttcaagaaaaatggaatcttatacttcagataaagctgttcttgaacattttttttcgtcattatcttagttaaccgagaa

SEQ ID NO: 2947 - DNA, 655 bp, Artificial
  Glycine max FAD3A mutation created with TALEN pair GmFAD3_T02.1
  misc_feature (263): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttntagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaacttcaccatcaaaatcatggacacattgagaagatgaatcctgggtccagtatgtgattaactacttcctctatagttatttttgattcaattaaatttatttatttaat

SEQ ID NO: 2948 - DNA, 706 bp, Artificial
  Glycine max FAD3A mutation created with TALEN pair GmFAD3_T02.1
  misc_feature (407); (465): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggactcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataactttttagcttcattgtcattgaaaagttcttttattaattatatttttattgcgtgtttggaatcccatttgagaataagaaatcncgtttaaatgtgaagttatactataacttttgactaaactgaaaaaatcacattttgntgtggaaccaaatctgattgagaaccaagttgattttgatggattttgcaggagaattagccacagaactcaccatcaaaatcatggacacattgagaaggtatgaatcctgggttccagtatgtgattaactacttcctctatagttatttttgattcaattaaatttatttatttaataagttcaagaaaaaaggaatctttatacttcagataaagctgattcttgaacatttttttt

SEQ ID NO: 2949 - DNA, 734 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttattttatttaataagttcaagaaaaatggaaatctttatacttcagataaagctgttcttgaacattttttttgtcattatctagttaaccg

SEQ ID NO: 2950 - DNA, 441 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacaatggccaccacctgctggggggtcaagccgtgggcctggcacagcaccggcaacagccgctggaccgtctccagcgcctgcttgccaccgccattgctggcgatggccaccacctgctgggggtcaagccgtgggcctggcacagcaccggcaacagccgctggaccgtctccagcgcctgcttgccaccgcattcctcaattcttgtgccataccatggatggttagttcattcccggctttttgtttgtcattggaagttcttttatt

SEQ ID NO: 2951 - DNA, 637 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaatt

SEQ ID NO: 2952 - DNA, 718 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacactattgctggcgatggccaccacctgctccggggtcaagccgtgggcctggcacagcaccggcaacagcgcctggaccgtctccagcgcctgcttgccaccaactcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatattttattgcgtgttggaatcccatttgagaaataagaaatcacgtttaaaatgtgaaagttatactattaactttgactaaacttgaaaaatcacattttgatgtggaaccaaatctgattgagaaccaagttgatttgatggattttgcaggagaattagccacagaactcaccatcaaaatcatggacacattgagaaggatgaatcctgggttccagtatgtgattaactacttcctctatagttatttttt

SEQ ID NO: 2953 - DNA, 733 bp, Artificial
  Glycine max FAD3A mutation created with TALEN pair GmFAD3_T02.1
  misc_feature (679): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttataagttcaagaaaaatggaatctttntacttcagataaagctgttcttgaacatttttttcgtcattatctagttaaccg

SEQ ID NO: 2954 - DNA, 737 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacagcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttgtcattatctagttaaccg

SEQ ID NO: 2955 - DNA, 737 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttataagttcaagaaaaatggaatctttatacttcagataaagctgttcttgaacattttttttcgtcattatctagttaaccg

SEQ ID NO: 2956 - DNA, 737 bp, Artificial
  Glycine max FAD3A mutation created with TALEN pair GmFAD3_T02.1
  misc_feature (654): n is a or c or t or g
cactgctttgttatgcctacctcatttcatttggctttagacaacttaaatttgagatctttattatgttttttgcttatatggtaaagtgattcattcttcacattgaattgaacagtggcccatggaagcttttcagacagcccttttctaaatagcctggtgggacactgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaaatgtgaaagttataactattaacttttgactaaacttgaaaaaaactcacattttgatgtggaaccaaatctgattgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttnttataagttcaagaaaaagaatctttatacttcagataaagctgttcttgaacattttttttcgtcattatcttagttaaccg

SEQ ID NO: 2957 - DNA, 726 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggatttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttgtcattatc

SEQ ID NO: 2958 - DNA, 562 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcagcaccggcaacagccgctggaccgtctccagcgcctgcttgccaccattattgctggcgatggccaccacctgctggggggtcaagccgtgggcctggttgcattcctcaattcttgtgccataccatggatggttagttcatcccggctttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatattttattgcgtgttggaatcccatttgagaaataagaatcacgtttaaatgtgaaagttataactattaacttttgactaaacttgaaaaaa

SEQ ID NO: 2959 - DNA, 735 bp, Artificial
  Glycine max FAD3A mutation created with TALEN pair GmFAD3_T02.1
  misc_feature (680): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacaacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaatggaaatctttntacttcagataaagctgttcttgaacattttttttcgtcattatctagttaaccg

SEQ ID NO: 2960 - DNA, 746 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacagcattcctcaattcttgtgccataccatggatggttagttcatcccggctttttttgtttgtcattggaagttcttttattgattcaatttttatagcgtgttcggaaacgcgtttcagaaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttgtcattatctagttaaccgagaagctttg

SEQ ID NO: 2961 - DNA, 653 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatctacaacctgcccatcggccaggccgacgaaatgcagaggtacgtggaggagaaccagaccaggaacaattcctcaattcttgtgccataccatggatggttagttcatcccggcttttttgttttgtcattggaagttcttttattgattcaatttttatagcgtgttcggaaacgcgtttcagaaaaataatgaaatacatcttgaatctgaaagttataacttttagcttcattgtcattgaaagttcttttaattaattataatttttattgcgtgtttggaattcccatttgagaaataagaaaatcacgtttaaaatgtgaaagttataactattaacttttgactaaacttgaaaaaaattcacattttgatgtggaaccaaatctgatttgagaaccaagttgattttgatggattttgcaggagaattagccacagaactcaccatcaaaatcatggacacattgagaagga

SEQ ID NO: 2962 - DNA, 710 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatgctggcgatggccaccacctgctggggggtcaagccgtgggcctggcacagcaccggcaacagcgcctgcaccgtctccagcgcctgcttttcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatattttattgcgtgtttggaatcccatttgagaataagaatcacgtttaaaatgtgaaagttataactattaactttagaactaaactttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagtt

SEQ ID NO: 2963 - DNA, 639 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacaagcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaacctacttcctctatagttattttgattcaatt

SEQ ID NO: 2964 - DNA, 739 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaacctacttcctctatagttatttttgattcaattaaatttattttatttaataagttcaagaaaaaatggaatctttatacttcagataaagctgttcttgaacattttttttcgtcattatcttagttaaccg

SEQ ID NO: 2965 - DNA, 587 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcccttttcctcaattcttgtgccataccatggatggttagttcatcccggcttttttgtttgtcattggaagttcttttattgattcaatttttatagcgtgttcggaacgcgtttcagaaaataatgaaatacatcttgaatctgaaagttataactttttagcttcattgtcattgaaaagttcttttattaattatatttttattgcgtgtttggaatcccatttgagaaattaagaaatcacgttttaaaatgtgaaagttataactattaacttttgactaaacttgaaaaaatcacattttgatgtggaaccaaatctgattttgagaaccaagttgaattttgatggattttgcatggagaattatgccacaagaactcaccattcaaaatcatggactacattgagaaggatgaatcctggg

SEQ ID NO: 2966 - DNA, 717 bp, Artificial
  Glycine max FAD3A mutation created with TALEN pair GmFAD3_T02.1
  misc_feature (682): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaacctacttcctctatagttatttttgattcaattaaatttatttatttaataagttcaagaaaaatggaatctttntacttcagataaagctgttcttgaacatttttttt

SEQ ID NO: 2967 - DNA, 737 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgatttttgatggattttgcaggagaatttagcccacagaactcaccatcaaaatcatggacacattgagaaggatgaatcctgggttccagtatgtgattaactacttcctctatagttatttttgattcaattaaatttatttatttaataagttcaagaaaaaaggaatctttatacttcagataaagctgattcttgaacatttttttgtcattatcttagttaaccgag

SEQ ID NO: 2968 - DNA, 733 bp, Artificial
  Glycine max FAD3A mutation created with TALEN pair GmFAD3_T02.1
  misc_feature (681): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttntacttcagataaagctgttcttgaacattttttttgtcattatctaagttaa

SEQ ID NO: 2969 - DNA, 643 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacaattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaattt

SEQ ID NO: 2970 - DNA, 655 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacagcattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaat

SEQ ID NO: 2971 - DNA, 654 bp, Artificial
  Glycine max FAD3A mutation created with TALEN pair GmFAD3_T02.1
cactgctttgttatgcctacctcatttcatttggctttagacaacttaaatttgagatctttattatgtttttttgcttatatggtaaagtgattcattcttcacattgaattgaacagtggccatggaagcttttcagacagccctttttctaaatagcctggtggaacagccctttttcagacattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagtttgattttgatggattttgcaggagaattagccacagaactcaccatcaaaatcatggacacattgagaaggatgaatcctgggttccagtatgtgattaactacttcctctatagttatttttgattcaatt

SEQ ID NO: 2972 - DNA, 685 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggactcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgttttggaatcccatttgagaaataagaaatcacgtttaaaaatgtgaaagttataactataacttttgactaaaacttgaaaaaatcacatttttgatgtggaaccaaatctgatttgagaaccaagttgattttgatggattttgcaggagaattagccacagaactcaccatcaaaatcatggacacattgagaaggtatgaaatcctgggttccagtatgtgattaactacttcctctatagttatttttgattcaattaaaatttatttatttaataagttcaagaaaaaaaggaatctttatac

SEQ ID NO: 2973 - DNA, 594 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttatgcgtgtttggaatcccatttgagaaataagaaatcacgtttaaatgtgaagttataactattacttttgactaaacttgaaaaatcacattttgatgtggaaccaaatctgatttgagaaccaagttgattttgatggattttgcaggagaattagccacagaactcaccatcaaaatcatggacacattgagaaggatgaatcctgggttccagtatgtgatt

SEQ ID NO: 2974 - DNA, 733 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacactattgctggcgatggccaccacctgctccggggtcaagccgtgggcctggcacagcaccggcaacagcgcctggaccgtctccagcgcctgcttgccaccaactcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatccccatttgagaaataagaaattcacgtttaaaatgtgaagttatactattaactttgactaaacttgaaaaatcacatttttgatgtggaaccaaatctgatttgagaaccaagttgattttgatggattttgcaggagaattagccacagaactcaccatcaaaatcatggacacattgagaagggatgaatcctgggttccagtatgtgattaactacttcctctatagttatttttgattcaatt

SEQ ID NO: 2975 - DNA, 753 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaaagttataacttttagcttcattgtcattgaaagttcttttattaattatattttttattgcgtgtttggaatcccatttgagaaataagaaatcacgtttaaatgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaacctacttcctctatagttatttttcgattcaatttaaatttattttcatttaataagttcaagaaaaaggaatcttatacttcagataaagctgttcttgaacattttttttcgtcattatcttagttaaccgagaagcttttgag

SEQ ID NO: 2976 - DNA, 680 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaggatgaatcctgggttccagtatgtgattaactacttcctctatagttatttttgattcaattaaatttatttattaataagttcaagaaaaaaggaatctttatacttcagataaagctg

SEQ ID NO: 2977 - DNA, 526 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggctttttttgtttgtcattggaagttcttttattgattcaattttttatagcgtgttcggaaacgcgtttcagaaaaataatgaaatacatcttgaatctgaaaagttataacttttagcttcattgtcattgaaaagttcttttattaattatatttttattgcgtgtttggaatcccatttgagaaataagaaatcacgtttaaaattgtgaaatgttataactattaacttttgactaaacttgaaaaaactcacattttgatgtggaaccaaatctgatttgagaaccaagttgattttgatgga

SEQ ID NO: 2978 - DNA, 644 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacatcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaaatgtgaaagttataactattaacttttgactaaacttgaaaaaaatcacattttgatgtggaaccaaatctgatttgagaaccaagttgattttgatggattttgcaggagaattagccacagaaactcaccatcaaaatcatggacacattgagaaggatgaatcctgggttccagtatgtgattaactacttcctctatatgttatttttgattcaattaaattt

SEQ ID NO: 2979 - DNA, 737 bp, Artificial
  Glycine max FAD3A mutation created with TALEN pair GmFAD3_T02.1
  misc_feature (682): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacagcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttntacttcagataaagctgttcttgaacattttttttcgtcattatctagttaaccg

SEQ ID NO: 2980 - DNA, 726 bp, Artificial
  Glycine max FAD3A mutation created with TALEN pair GmFAD3_T02.1
  misc_feature (467): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaactgtgaaagttataactattaacttttgactaaacttgaaaaaattcacatttttgntgtggaaccaaatctgatttgagaaccaagttgattttgatggattttgcaggagaatttagccacagaactcaccatcaaaattcatggacacattgagaaggatgaatcctgggttccagtatgtgattaactacttcctctatagttatttttcgattcaatttaaatttatttatttaataagttcaagaaaaaagggaatctttatacttcagataaatgctgttcttgaacatttttttagtcattatcttag

SEQ ID NO: 2981 - DNA, 713 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatgcaaatatttcttgtcaaaaatgctccactgacgttccataaattcccctcggtatccaattagagtctcatcttgcattcctcaattcttgtgccataccatggatggttagttcatcccggctttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaatcacgtttaaaatgtgaaagttataactattaactttgactaaacttgaaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattactacttcctctatagttatttttggattcaatt

SEQ ID NO: 2982 - DNA, 612 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacgcattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaagttataactattaacttttgactaaacttgaaaaaatcacatttttgatgtggaaccaaatctgatttgagaaccaagtttgattttgatggattttgcaggagaattagccacagaaacttcaccatcaaaagtcatggacacattgagaaggatgaatcctgggttccagtatgtgattaaccta

SEQ ID NO: 2983 - DNA, 605 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcaattcttgtgccataccatggatggttagttcatcccggcttttttgtttgtcattggaagttctttttattgaattcaatttttatagcgtgtttcggaaacgcgtttcagaaaataatgaaaatacatcttgaatctgaaaagttataacttttagcttcattgtcattgaaagttcttttattaattatattttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaa

SEQ ID NO: 2984 - DNA, 823 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacagcaccggcaacagcgcctgcaccgtctccagcgcctgcttgccaccaatattgctggcgatggccaccacctgctccggggtcaagccgtgggcctggcacagcaccggcaacagccgctggaccgtctcgcattcctcaattcttgtgccataccatggatggttagttcatcccggcttttttgtttgtcattggaagttcttttattgatcaatttttatagcgtgttcggaaacgcgtttcagaaaataatgaatacatcttgaatctgaaagttataacttttagcttcattgtcattgaagttctttattaattatatttttattgcgtgtttggaatcccatttgagaaataagaaatcacgttaaaatgtgaaagttataactattaacttttgactaaacttgaaaaaaatcacatttttgtgtgggaaccaaatctgatttgagaaccaagttgattttgatggatttttgcaggagaatttagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaag

SEQ ID NO: 2985 - DNA, 628 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatccagcgcctgcttgccaccattattgctggcgatggccaccacctgctggggggtcaagccgtgggcctggcacagcaccggcaacagccgctggaccgtctccagcgcctgcttgccaccgccattgctggcgatggccaccacctgctggggggtcaagtcttgcattcctcaattcttgtgccataccatggatggttagttcatcccggctttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaa

SEQ ID NO: 2986 - DNA, 809 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacggtggcgatggccaccacctgctccggggtcaagccgtgggcctggcacagcacccggcaacagcgcctgcaccgtctccagcgcctgctgcattcctcaattcttgtgccataccatggatggttagttcatcccggcttttttgtttgtcattggaagttctttttattgattcaatttttatagcgtgttcggaaacgcgtttcagaaaataatgaaatacatcttgaatctgaaagttataacttttagcttcattgtcattgaaagttcttttattaattatattttattgcgtgttggaatcccatttgagaaataagaatcacgtttaaatgtgaaagttataactattaactttgactaaacttgaaaaaatcacattttgatgtggaaccaaatctgatttgagaaccaagttgattttgatggattttgcaggagaattagccacagaactcaccatcaaaatcatggacacattgagaagggatgaatcctgggttccagtatgtgattaactacttcctctatagttatttttgattcaattaatttatttatttaataagttcaagaaaaacggaatctttatacttcagataaagctgttcttgaaacatttttttcgtcattat

SEQ ID NO: 2987 - DNA, 475 bp, Artificial
  Glycine max FAD3A mutation created with TALEN pair GmFAD3_T02.1
  misc_feature (473): n is a or c or t or g
cactgctttgttaatgcctacctcatttcatttggctttagacaacttaaatttgagatctttattatgttttttgcttatatggtaaagtgattcattcttcacattgaattgaacagtggccatggaagcttttcagacagcccttttctaaatagcctggtggggcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaatagaaatcacgtttaaaatgtgaagttataactattaacttttgactaaacttgaaaaaattcacatttttgntg

SEQ ID NO: 2988 - DNA, 744 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggctttttttgtttgtcattggaagttcttttattgattcaattttttatagcgtgttcggaaacgcgtttcagaaaaataatgaaatacatcttgaatctgaaaagttataacttttagcttcattgtcattgaaaagttcttttattaattatatttttattgcgtgtttggaatcccatttgagaaataagaaatcacgtttaaaatgtgaaagttataactattaacttttgactaaacttgaaaaaaactcacattttgatgtggaaccaaatctgatttgagaaccaagttgattttgatggattttgcaggagaattagccacagaactcaccatcaaaagtcatggacacattgagaaggatgaatcctgggttccagtatgtgattaacctacttcctctatagttatttttgattcaattaaatttattttatttaataagttcaagaaaaatggaatctttatacttcagataaagctgttcttgaacattttttttcgtcattatctagttaaccg

SEQ ID NO: 2989 - DNA, 703 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacatccagcggctgttgccggtgctgtgccaggcccacggcttgaccccttgcattcctcaattcttgtgccataccatggatggttagttcatcccggcttttttgtttgtcattggaagttcttttattgattcaatttttatagcgtgttcggaaaacgcgtttcagaaaataatgaaaatacatcttgaatctgaaagttataacttttagcttcattgtcattgaaagttcttttattaattatatttttattgcgtgtttggaatcccatttgagaaataagaaattcacgtttaaaatgtgaaagttataactattaacttttgactaaacttgaaaaaagtcacattttgatgtggaaccaaatctgatttgagaaccaagttgatttgatggattttgcaggagaattagccacagaactcaccatcaaaatcatggacacattgagaaggtatgaatcctgggtttccagtatgtgattaactacttcctctatagttatttttcgattcaattaaattatttattt

SEQ ID NO: 2990 - DNA, 822 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacatctccagcgcctgcttgccaccattattgctggcgatggccaccacctgctggggggtcaagccgtgggcctggcacagcaccggcaacagcgtcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatattttattgcgtgttggaatcccatttgagaaataagaatcacgtttaaatgtgaaagttataactattaactttgactaaacttgaaaaaagtcacatttttgatgtggaaccaaatctgatttgagaaccaagttgattttgatggattttgcaggagaattagccacagaactcaccatcaaaatcatggacacattgagaagggatgaatcctgggttccagtatgtgattaactacttcctctatagttatttttggattcaattaatttatttatttaataagttcaagaaaaacggaatctttatacttcagattaaagctgttcttgaaacattttttttcgtcattatctt

SEQ ID NO: 2991 - DNA, 741 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttgtcattatctagttaaccgagaa

SEQ ID NO: 2992 - DNA, 594 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacagcattcctcaattcttgtgccataccatggatggttagttcatcccggcttttttgttgtcattggaagttctttttattgatcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggatgaattagccacagaactcaccatcaaaatcatggacacattgagaaggatgaatcctgggttccag

SEQ ID NO: 2993 - DNA, 736 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacattggcccacggcttgaccccggagcaggtggtggccatcgccagccacgatggcggcaagcaggcgctggagacggtccagcggctgttgccggtgctgtgccaggcccattcctcaattctttgtgccataccatggatggttagttcatcccggctttttgtttgtcattggaagttcttttattgattcaatttttatagcgtgttcggaaacgcgtttcagaaataatgaaatacatcttgaatctgaaagttataacttttagcttcattgtcattgaaaagttcttttattaattatattttattgcgtgtttggaatcccatttgagaaataagaaatcacgtttaaaatgtgaaagttataactattaacttttgactaaacttgaaaaaagtcacatttttgatgtggaaccaaatctgatttgagaaccaagttgattttgatggattttgcaggagaattagccacagaactcaccatcaaaatcatggacacattgagaagggatgaatcctgggttccagtatgtgattaactacttcctctatagttattttt

SEQ ID NO: 2994 - DNA, 662 bp, Artificial
  Glycine max FAD3A mutation created with TALEN pair GmFAD3_T02.1
cactgctttgttatgcctacctcatttcatttggctttagacaacttaaatttgagatctttattatgtttttttgcttatatggtaaagtgattcattcttcacattgaattgaacagtggccatggaagcttttcagacagcccttttctaaatagcctggtggggacactgctgtccttccattcatttgcttgcgtcatcactagatggattgtgtgtcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttattta

SEQ ID NO: 2995 - DNA, 613 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttgtgccataccatggatggttagttcatcccggctttttgtttgtcattggaagttcttttattgattcaatttttatagcgtgttcggaaacgcgtttcagaaaataatgaaatacatcttgaatctgaaagttatacttttagcttcattgtcattgaaagttcttttattaattatatttttattgcgtgtttggaatcccatttgagaaataagaaatcacgtttaaaatgtgaaaagttataactattaacttttgactaaaacttgaaaaaatcacatttttgatgtggaaccaaattctgatttgagaaccaagttgattttgatggattttgcaggagaattagccacagaactcaccatcaaaatcattggacacattgagaaggatgaatcctgggttccagtatgtgattaactacttcctctatagttattttgattcaattaaatttatttatttaataagttcaagaaaaatggaatctttatacttcagataaagctg

SEQ ID NO: 2996 - DNA, 477 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcgctggagacggtccagcggctgttgccggtgctgtgccaggcccacggcttgaccccggagcaggtggtggccatcgccagccacgatggcggcaacagccgctggaccattcctcaattcttgtgccataccatggatggtttagttcatcccgggcttttttgtttgtcattggaagttctttttattgattcaatttttatagcgtgttcggaaacgcgtttcagaaaataatgaaatacatcttgaatctgaaagttataacttttagcttcattgtcattgaaagttcttttattaatta

SEQ ID NO: 2997 - DNA, 663 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggagcattcctcaattcttgtgccataccatggatggttagttcatcccggcttttttgttttgtcattggaagttctttttattgattcaatttttatagcgtgttcggaaacgcgtttcagaaaattaatgaaaatacatcttgaatctgaaagttataacttttagcttcattgtcattgaaagttcttttattaattatattttttattgcgtgtttggaatcccatttgagaaataagaaatcacgtttaaaatgtgaaatgttataactattaacttttgactaaacttgaaaaaactcacatttttgatgtggaaccaaattctgatttgagaaccaagttgatttttgatggattttgcaggagaattagccacagaaactcaccatcaaaagtcatggacacattgagaaggatgaatcctgggttccagtatgtgattaacctacttcctctatagtatttttcgattcaattaaatttatttatttat

SEQ ID NO: 2998 - DNA, 694 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacgcattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaatgtgaagttataactattaacttttgactaaacttgaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttccctatagtatttttgatcaattaatttatttcatttatagttcaagaaaaggaatctttatacttcgataaagctgttcttttgaa

SEQ ID NO: 2999 - DNA, 731 bp, Artificial
  Glycine max FAD3A mutation created with TALEN pair GmFAD3_T02.1
  misc_feature (647); (670): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcaattcttgtgccataccatggatggttagttcatcccggcttttttgttttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaacctacttcctctatagttattttttgattcaattaaatttatttntttataagttcaagaaaaagganctttatacttcagataaagctgttcttgaacattttttttcgtcattatcttagttaaccg

SEQ ID NO: 3000 - DNA, 739 bp, Artificial; identical to SEQ ID NO: 1543
  Glycine max FAD3A mutation created with TALEN pair GmFAD3_T02.1

SEQ ID NO: 3001 - DNA, 716 bp, Artificial
  Glycine max FAD3A mutation created with TALEN pair GmFAD3_T02.1
cactgctttgttatgcctacctcatttcatttggctttagacaacttaaattttgagatctttattatgtttttttgcttatatggtaaagtgattcattcttcacattgaattgaacagtggccatggaagcttttcagacagcccttttctaaatagcctggtggaacagccctttttcagacattcctcaattcttgtgccataccatggatggttagttcatcccggctttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattccaattaaatttatttatttaataagttcaagaaaaaaggaatctttatacttcagataaagctgttc

SEQ ID NO: 3002 - DNA, 831 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacaaaaatcgacgctcaagtcagaggtggcgaaacccgacaggactataaagataccaggcgtttccccctggaagctccctcgtgcgctctcctgttccgaccctgccgcttaccggatacctgtccgccttgcattcctcaattcttgtgccataccatggatggttagttcatcccggctttttgtttgtcattggaagttcttttattgatcaatttttatagcgtgttcggaaacgcgtttcagaaaataatgaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaatcacattttgtgtggaaccaaatctgatttgagaaccaagttgattttgatggattttgcaggagaatttagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagtctgttcttgaa

SEQ ID NO: 3003 - DNA, 737 bp, Artificial; identical to SEQ ID NO: 1675
  Glycine max FAD3A mutation created with TALEN pair GmFAD3_T02.1

SEQ ID NO: 3004 - DNA, 640 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagcattcctcaattcttgtgccatatcatggatggttagttcatcccggcttttttgtttgtcattggaagttcttttattgattcaatttttatagcgtgttcggaaacgcgtttcagaaaataatgaaatacatcttgaatctgaaagttataacttttagcttcatttgtcattgaaaagttctttttattaattatattttattgcgtgtttggaatcccatttgagaaataagaaatcacgtttaaaattgtgaaagttataactattaacttttgactaaacttgaaaaaactcacatttttgatgtggaaccaaatctgattttgagaaccaagttgattttgatggattttgcaggagaattagccacagaactcaccatcaaaatcatggacacattgagaaggatgaatcctgggttccagtatgtgattaactacttcctctatagttattttgattcaattaaatttatttatttaataagttcaagaaaaa

SEQ ID NO: 3005 - DNA, 592 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggatcaattcttgtgccataccatggatggttagttcatcccggcttttttgtttgtcattggaagttcttttattgattcaatttttatagcgtgttcggaaaacgcgtttcagaaaataaatgaaaatacatcttgaatctgaaaagttataacttttagcttcattgtcattgaaaagttcttttattaattatatttttattgcgtgtttggaaatcccatttgagaaataagaaatcacgtttaaaaatgtgaaagttataactattaacttttgactaaacttgaaaaaatcacatttttgatgtggaaccaaaatctgaatttgagaaccaatgttgatttgatggaattttgcaggagaattagccacagaactcaccatcaaaaatcatggacacattgagaaggatgaatcctgggtt

SEQ ID NO: 3006 - DNA, 761 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctgggtggacacatcagcagccggcaacagcgcctgcaccgtctccagcgcctgcttgccaccaatattgctggcgatggccaccacctgctccggggtcaagccgcggtccagcggctgttgccggtgctgtgccaggcccacggcttgcattcctcaattcttgtgccataccatggatggttagttcatcccggcttttttgtttgtcattggaagttcttttattgattcaattttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaaactttgaaaaaatcacatttttgatgtggaaccaaatctgatttgagaaccaagttgatttttgatggatttttgcaggagaattagccacagaactcaccattcaaaatcatggacacattgagaaggatgaatcctgggttccagtatgtgattaagctacttcctct

SEQ ID NO: 3007 - DNA, 584 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacactcaacttgaccccccagcaggtggtggccatcgccagccacgatggcggcaaggagacggtgcaggcgctgttgccggtgctgtgccaggcccacggcttgaccccggagcaggtggtggccattcctcaattcttgtgccataccatggatggttagttcatcccggctttttgtttgtcattggaagttcttttattgattcaatttttatagcgtgttcggaaacgcgtttcagaaataatgaaatacatcttgaatctgaaagttataacttttagcttcattgtcattgaaagttcttttattaattatatttttattgcgtgttggaatccccatttgagaaataagaatcacgtttaaaatgtgaaagttatactattactttgactaaacttagaaaaaagtcaca

SEQ ID NO: 3008 - DNA, 639 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtggcttgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatccgggttccagtatgtgattaactacttcctctatagttatttttgatcaattaaa

SEQ ID NO: 3009 - DNA, 737 bp, Artificial; identical to SEQ ID NO: 2862
  Glycine max FAD3A mutation created with TALEN pair GmFAD3_T02.1
  misc_feature (683): n is a or c or t or g

SEQ ID NO: 3010 - DNA, 713 bp, Artificial
  Glycine max FAD3A mutation created with TALEN pair GmFAD3_T02.1
  misc_feature (678): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaagtcatggacacattgagaaggatgaatcctgggttccagtatgtgattaacctacttcctctatagtatttttgattcaattaaatttatttatttataagttcaagaaaatgaatctttntacttcagataaagctgttctgaacattttttttc

SEQ ID NO: 3011 - DNA, 716 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttgaagtggtggcctaactacggctacactagaagaacagtatttggtatctgcgctctgctgaagccagttaccttcggaaaaagagttggtagctcttgtccggcaaacaaaaccaccgctacgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagctcattgtcattgaaagttcttttattaattatattttattgcgtgtttggaatcccatttgagaaataagaaatcacgttaaaatgtgaaagttataactattaactttgactaaacttgaaaaaactcacatttttgatgtggaaccaaatctgatttgagaaccaagttgattttgatggatttttgcaggagaattagccacagaactcaccatcaaatcatggacacattgagaaggatgaatcctgggtt

SEQ ID NO: 3012 - DNA, 739 bp, Artificial
  Glycine max FAD3A mutation created with TALEN pair GmFAD3_T02.1
  misc_feature (684): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggttcttgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatgggacacattgagaaggatgaatcctgggttccagtatgtgattaactacttcctctatagttatttttgattcaattaaatttattttatttaataagttcaagaaaataggaaagatctttntacttcagataaagctgttcttgaacattttttttcgtcattatctagttaaccg

SEQ ID NO: 3013 - DNA, 610 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacatgcattcctcaattcttgtgccataccatggatggttagttcatcccggctttttttgtttgtcattggaagttctttttattgattcaatttttatagcgtgttcggaaacgcgtttcgaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaa

SEQ ID NO: 3014 - DNA, 530 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacactctggagacggtccagcggctgttgccggtgctgtgccaggcccacggcttgacccccggagcaggtggtggccatcgccagccacgatggcggcaagcaggcgctggagacggtccagcggctgttgccggtgctgtgccaggcccacggcttgacccccgagcaggtggtgagcattcctcaattcttgtgccataccatggatggttagttcatcccggcttttttgtttgtcattggaagttcttttattgattcaatttttgatagcgtgttcggaaacgcgttcagaaaataatgaatacatcttgaatctgaaagttataacttttagcttcattgtcattgaaagttctttt

SEQ ID NO: 3015 - DNA, 604 bp, Artificial
  Glycine max FAD3A mutation created with TALEN pair GmFAD3_T02.1
cactgctttgtatgcctacctcatttcatttggctttagacaacttaaattttgagatcttttattatgttttttgcttatatggtaaagtgattcattcttcacattgaattgaacagtggccatggaagcttttcagacagcccttttctaaatagcctggtgggacaagcattcctcaattcttgtgccataccatggatggttagttcatcccggcttttttgtttgtcattggaagttctttttattgattcaatttttatagcgtgttcggaaacgcgtttcagaaaataatgaaaatacatctttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatgggacacattgagaaggatgaatcctgggttccagtatg

SEQ ID NO: 3016 - DNA, 739 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaaactcaccatcaaaatcatggacacattgagaaggatgaatcctgggttccagtatgtgattaactacttcctctatagttatttttgattcaattaaatttatttatttaaataagttcaagaaaaaggaatctttatacttcagataaagctgttcttgaacattttttttgtcattatcttagttaaccg

SEQ ID NO: 3017 - DNA, 729 bp, Artificial
  Glycine max FAD3A mutation created with TALEN pair GmFAD3_T02.1
  misc_feature (681): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttntacttcagataaagctgttcttgaacattttttttcgtcattatctag

SEQ ID NO: 3018 - DNA, 730 bp, Artificial
  Glycine max FAD3A mutation created with TALEN pair GmFAD3_T02.1
  misc_feature (683): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttntacttcagataaagctgttcttgaacattttttttgtcattatctag

SEQ ID NO: 3019 - DNA, 727 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacactattgctggcgatggccaccacctgctccggggtcaagccgtgggcctggcacagcaccggcaacagcgcctggaccgtctccagcgcctgcttgccaccaactcaattcttgtgccataccatggatggttagttcatcccggctttttgtttgtcattggaagttcttttattgattcaatttttatagcgtgttcggaaacgcgtttcagaaataatgaaatacatcttgaatctgaaagttataacttttagcttcattgtcattgaaagttcttttattaattatattttattgcgtgttggaatccccatttgagaaataagaatcacgtttaaatgtgaaagttataactattaactttgactaaacttgaaaaaatcacatttttgatgtggaaccaaatctgatttgagaaccaagttgattttgatggattttgcagggagaattagccacagaactcaccatcaaaatcatggacacattgagaaggatgaatcctgggttccagtatgtgattaactacttcctctatagttatttttgattcaa

SEQ ID NO: 3020 - DNA, 710 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacacatcttgcattcctcaattcttgtgccataccatggatggttagttcatcccggctttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgattttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaaaggaatctttatacttcagataaagctgttcttgaacattttttttgtcattatcttag

SEQ ID NO: 3021 - DNA, 737 bp, Artificial
  Glycine max FAD3A mutation created with TALEN pair GmFAD3_T02.1
  misc_feature (683): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttntacttcagataaagctgttcttgaacatttttttcgtcattatctagttaaccg

SEQ ID NO: 3022 - DNA, 735 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagccttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaaatgtgaaagttataactattaacttttgactaaacttgaaaaaatcacatttttgatgtggaaccaaatctgaatttgagaaccaagttgattttgaatggattttgcaggagaatttagccacagaactcaccatcaaaatcatggacacattgagaaggtatgaatcctgggttccagtatgtgattaactacttcctctatagttatttttgattcaattaaatttatttatttaataagttcaagaaaaaaaggaatcttatacttcagataaagctgatcttgaacattttttttgtcattatcttagttaaccgag

SEQ ID NO: 3023 - DNA, 737 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatattttttattgcgtgtttggaatcccatttgagaaataagaaatcacgtttaaaatgtgaaagttataactattaacttttgactaaacttgaaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttataagttcaagaaaaatggaatctttatacttcagataaagctgttcttgaacatttttttttcgtcattatctagttaacc

SEQ ID NO: 3024 - DNA, 696 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcattcctcaattcttgtgccataccatggatggttagttcatcccggcttttttgtttgtcattgggaagttcttttattgattcaatttttatagcgtgttcggaaacgcgtttcagaaaataatgaaatacatcttgaatctgaaagttataacttttagcttcattgtcattgaaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaaatcatggacacattgagaaggatgaatcctgggttccagtatgtgattaactacttcctctatagttatttttgattcaattaaaatttatttatttaataagttcaagaaaaaaggaatctttatacttcagataaagctgttcttgaacattttttttgtcattatcttagttaacc

SEQ ID NO: 3025 - DNA, 737 bp, Artificial; identical to SEQ ID NO: 2054
  Glycine max FAD3A mutation created with TALEN pair GmFAD3_T02.1
  misc_feature (682): n is a or c or t or g

SEQ ID NO: 3026 - DNA, 612 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgttgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaaacttgaaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactactt

SEQ ID NO: 3027 - DNA, 683 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacaacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaatttatttatttaataagttcaagaaaaaggaatctatacttcag

SEQ ID NO: 3028 - DNA, 717 bp, Artificial
  Glycine max FAD3A mutation created with TALEN pair GmFAD3_T02.1
cactgctttgttaatgcctacctcatttcatttggctttagacaacttaaatttgagatctttattatgttttttgcttatatggtaaagtgattcattcttcacattgaattgaacagtggccatggaagcttttcagacagcccttttctaaatagcctggtggggcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttctttattaattatatttttattgcgtgttttggaatcccatttgagaaataagaaatcacgtttaaaatgtgaaagttataactattaacttttgactaaacttgaaaaaattcacatttttgatgtggaaccaaatctgatttgagaaccaagttgattttgatggattttgcaggagaatttagccacagaactcaccatcaaaatcatggacacattgagaaggatgaatcctgggttccagtatgtgattaactacttcctctatagttatttttgattcaattaaatttatttatttaataagttcaagaaaaaagggaatctttatacttcagataaagctgttcttgaacatttttttt

SEQ ID NO: 3029 - DNA, 562 bp, Artificial
  Glycine max FAD3A mutation created with TALEN pair GmFAD3_T02.1
cactgctttgttatgcctacctcatttcatttggctttagacaacttaaatttgtagatctttattatgttttttgcttatatggtaaagtgattcattcttcacattgaattgaacagtggcccatggaagcttttcagacagcccttttctaaatagcctggtgggacattcctcaattcttgtgccataccatggatggttagttcatcccggcttttttgttttgtcattggaagttcttttattgattcaatttttatagcgtgttcggaaacgcgtttcagaaaataatgaaaatacatcttgaatctgaaaagttataaacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcat

SEQ ID NO: 3030 - DNA, 729 bp, Artificial
  Glycine max FAD3A mutation created with TALEN pair GmFAD3_T02.1
  misc_feature (684): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaacctacttcctctatagttatttttgattcaattaaatttatttatttaataagttcaagaaaaatggaatctttntacttcagataaagctgttcttgaacattttttttcgtcattatc

SEQ ID NO: 3031 - DNA, 611 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacttgcattcctcaattcttgtgccataccatggatggttagttcatcccggctttttttcgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaatgttataactattaacttttgactaaacttgaaaaaactcacattttgatgtggaaccaaattctgatttgagaaccaagttgattttgatggattttcgcaggagaattagccacagaactcaccatcaaaatcatggacacattgagaaggatgaatcctgggttccagtatgtgatt

SEQ ID NO: 3032 - DNA, 768 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacttgccggtgctgtgccaggcccacggcttgaccccggagcaggtggtggccatcgccagcaatggcggtggcaagcaggcgctggagacggtccagcggctgttgccggtgctgtgccaggcccacggctttgaccccggagcaggtggtggccatcgccagcaattcctcaattcttgtgccataccatggatggttagttcatcccggcttttttggtttgtcattggaagttcttttattgattcaatttttatagcgtgttcggaaacgcgtttcagaaattaatgaaatacatcttgaatctgaaagttataacttttagcttcattgtcattgaaagttcttttattaattatatttttattgcgtgtttggaatcccatttgagaaataagaaatcacgtttaaaatgtgaaatgttataactattaactttgactaaacttgaaaaatcacatttttgatgtggaaccaaatctgatttgagaaccaagttgattttgatggattttgcaggagaattagccacagaactcaccattcaaaatcattggacacattgagaaggatgaatcctgggttccagtatgtgatt

SEQ ID NO: 3033 - DNA, 741 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtggattcctcaattcttgtgccataccatggatggttagttcatcccggcttttttgtttgtcattggaagttcttttattgattcaatttttatagcgtgttcggaaacgcgttttcagaaaataatgaaatacatcttgaatctgaaaagttataacttttagcttcattgtcattgaaaagttcttttattaattatatttttattgcgtgtttggaatcccatttgagaaataagaaatcacgtttaaaaatgtgaaagttataactattaacttttgactaaacttgaaaaaattcacatttttgatgtggaaccaaatctgatttgagaaccaagttgatttttgatgggattttgcaggagaattagccacagaactcaccatcaaaattcatggacacattgagaagggatgaatcctgggttccagtatgtgattaactacttcctctatagttatttttgattcaattaaatttatttattaataagttcaagaaaaaagggaatctttatacttcagataaagctgttacttgaacattttttttagtcattatcttagttaaccgag

SEQ ID NO: 3034 - DNA, 698 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcattcctcaattcttgtgccataccatggatggttagttcatcccggcttttttgtttgtcattggaagttcttttattgattcaatttttatagcgtgttcggaaacgcgtttcagaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactatttaacttttgactaaacttgaaaaaatcacatttttgatgtggaaccaaatctgatttgagaaccaagttgattttgatggattttgcaggagaattagccacagaactcaccatcaaaaatcatggacacattgagaaggatgaatcctgggttccagtatgtgattaactacttcctctatagttatttttgattcaattaaatttatttatttaataagttcaagaaaaaaggaatctttatacttcagataaagctgttcttgaacattttttttgtcattattcttagttaaccgag

SEQ ID NO: 3035 - DNA, 662 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatctccagcgcctgcttgccaccaatattgctggcgatggccaccacctgctccggggtcaagccgtgggcctggcacagcaccggcaacagccgctggagcattcctcaattcttgtgccataccatggatggttagttcatcccggctttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgttggaatcccatttgagaaataagaaatcacgtttaaaatgtgaaagttataactattaactttgactaaacttgaaaaatcacattttgatgtggaaccaaatctgatttgagaaccaagttagattttgatggattttgcaggagaattagccacagaactcaccatcaaaatcatggaca

SEQ ID NO: 3036 - DNA, 710 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggatcgccagcaataatggtggcaagcaggcgctggagacggtccagcggctgttgccggtgctgtgccaggcccattcctcaattcttgtgccataccatggatggttagttcatcccggctttttttcgtttgtcattggaagttcttttattgattcaatttttaatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaattcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaatt

SEQ ID NO: 3037 - DNA, 561 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggatcttgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaaatgtgaaagttataactattaacttttgactaaaacttgaaaaaaatcacatttttgatgtggaaccaaaatctgatttgagaaccaagttgattttgatggattttgcaggagaattagccacagaactcaccatc

SEQ ID NO: 3038 - DNA, 730 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggatgcattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttccctatagttatttttgattcaattaaatttatttatttataagttcaagaaaaaggaagtctttattacttcagataaagctgttctgaacattttttttgtcattatctagttaaccg

SEQ ID NO: 3039 - DNA, 717 bp, Artificial
  Glycine max FAD3A mutation created with TALEN pair GmFAD3_T02.1
  misc_feature (682): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacttgcattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaacctacttcctctatagttatttttgattcaattaaatttatttatttaataagttcaagaaaaatggaatctttntacttcagataaagctgttcttgaacatttttttt

SEQ ID NO: 3040 - DNA, 622 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagtctggtgggcattcctcaattcttgtgccataccatggatggttagttcatcccggcttttttgtttgtcattggaagttcttttattgattcaattttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaatgtgaaagttataactattaacttttgactaaacttgaaaaaattcacatttttgatgtggaaccaaatctgatttgagaaccaagttgattttgattggattttgcaggagaattagccacagaactcaccatcaaaatcatggacacattgagaaggatgaatcctgggttccagtatgtgattaactacttcctctatagtta

SEQ ID NO: 3041 - DNA, 647 bp, Artificial
  Glycine max FAD3A mutation created with TALEN pair GmFAD3_T02.1
cactgctttgttatgcctacctcattttttttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaagttcttttattaattatatttttattgcgtgtttggaatcccatttgagaataagaaatcacgtttaaaatgtgaagttataactattaacttttgactaaacttgaaaaaattcacatttttgatgtggaaccaaatctgatttgagaaccaagttgattttgatggattttgcaggagaatttagccacagaactcaccatcaaaatcatggacacattgagaaggtatgaatcctgggttccagtatgtgattaactacttcctctatagttatttttgattcaattaaattta

SEQ ID NO: 3042 - DNA, 628 bp, Artificial
  Glycine max FAD3A mutation created with TALEN pair GmFAD3_T02.1
cactgctttgttatgcctacctcatttcatttggctttagacaacttaaaatttgtagatctttattatgtttttttgcttatatggtaaagtgattcattcttcacattgaattgaacagtggcccatggaagcttttcagacagcccttttctaaaatagcctggtggaacagccccttttttcagacatttcctcaattcttgtgccataccatggatggttagttcattcccggctttttttgtttgtcattggtaagttctttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaactttttgactaaacttgaaaaaactcacatttttgatgtggaaccaaatctgatttgagaaccaagtttgattttgatggattttgcaggagaattagccacagaactcaccatcaaaagtcatggacacattgagaaggatgaatcctgggttccagtatg

SEQ ID NO: 3043 - DNA, 644 bp, Artificial
  Glycine max FAD3A mutation created with TALEN pair GmFAD3_T02.1
  misc_feature (252): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacgcattcctcaattcttgtgccataccatggatggttagttcatcccggcttttttgtttgtcattgggaagttctttttattgnttcaatttttatagcgtgttcggaaacgcgtttcagaaaattaatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaactcacatttttgatgtggaaccaaatctgatttgagaaccaagttgattttgatggattttgcaggagaattagccacagaactcaccatcaaaagtcatggacacattgagaaggatgaatcctgggttccagtatgtgattaacctacttcctctatagttatttttgattcaatt

SEQ ID NO: 3044 - DNA, 670 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtggggcacgtactcatgaaggtgtacggctacaggggcaagcattcctcaattcttgtgccataccatggatggttagttcatcccggctttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaatcacattttgatgtggaaccaaatctgatttgagaaccaagttgatttgatggattttgcaggagaattagccacagaactcaccatcaaatcatggacacattgagaaggatgaatcctgggttccagtatgtgattaactacttcctctatagttatttttgattcaattaaa

SEQ ID NO: 3045 - DNA, 766 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatgctggcgatggccaccacctgctggggggtcaagccgtgggcctggcacagcaccggcaacagcgcctgcaccgtctccagcgcctgcttttcctcaattcttgtgccataccatggatggttagttcatcccggctttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatattttattgcgtgttggaatcccattgagaataagaatcacgtttaaatgtgaagttataactattactttagactaaacttgaaaaagtcacattttgatgtggaaccaaatctgatttgagaaccaagttgattttgatggattttgcaggagaattagccacagaactcaccatcaaaatcatggacacattgagaagggatgaatcctgggttccagtatgtgattaactacttcctctatagttatttttggattcaatttaatttatttatttaataagttcaagaaaaacggaatctttatactt

SEQ ID NO: 3046 - DNA, 546 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggaattcttgtgccataccatggatggttagttcatcccggcttttttgtttgtcattggaagttctttattgattcaattttatagcgttgttcggaaacgcgtttcagaaaataatgaaatacatcttgaatctgaaagttataacttttagcttcattgtcattgaaagttcttttattaattatattttattgcgttgtttggaatcccatttgagaaattaagaaatcatcgttttaaaatgtgaaagttataactattaacttttagactaaacttgaaaaaacttcaacattttgatgtggaaccaaattctgattttgagaaccaagttgaatttgatggatttgcaggagaattagccacagaactcaccatcaaaa

SEQ ID NO: 3047 - DNA, 640 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacactgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaatt

SEQ ID NO: 3048 - DNA, 728 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacatgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttattttatttaataagttcaagaaaaatggaatctttatacttcagataaagctgttcttgaacattttttttcgtcattatct

SEQ ID NO: 3049 - DNA, 615 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaaagttcttttattaattatatttttattgcgtgtttggaatcccatttgagaaataagaaatcacgtttaaaaatgtgaaagttataactattaacttttgactaaaacttgaaaaaaatcacattttgatgtggaaccaaatctgatttgaagaaccaagttgattttgaatggattttgcaggagaattagccacagaactcaccatcaaaatcatggacacattgagaaggatgaatcctgggttccagtatgtgattaact

SEQ ID NO: 3050 - DNA, 730 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaaggaatctttatacttcagataaagctgttcttgaacattttttttgtcattatcttagttaaccg

SEQ ID NO: 3051 - DNA, 474 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcaagccgtgggcctggcacagcaccggcaacagccgctggaccgtctccagcgcctgcttgccaccgccattgctggcgatggccaccacctgctggggggtcaagccgtgggcctggcacagcattgcattcctcaattcttgtgccataccatggatggttagttcatcccggcttttttgttgtcattgggaagttcttttattgatcaatttttatagcgtgttcggaaacgcgtttcagaaaactaatgaaatacatcttgaatctgaaagttataacttttagcttcattgtcatt

SEQ ID NO: 3052 - DNA, 654 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattccttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaaagttcttttattaattatatttttattgcgtgtttggaatcccatttgagaaataagaaatcacgtttaaaaatgtgaaagttataactattaacttttgactaaaacttgaaaaaaactcacatttttgatgtggaaccaaatctgatttgagaaccaagttgattttgatggattttgcaggagaattagccacagaaactcaccatcaaaaagtcatgggacacattgagaaggatgaatcctgggttccagtatgtgattaacctacttcctctatagttatttttgattcaattaaa

SEQ ID NO: 3053 - DNA, 736 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttcgtcattatctagttaaccg

SEQ ID NO: 3054 - DNA, 728 bp, Artificial
  Glycine max FAD3A mutation created with TALEN pair GmFAD3_T02.1
  misc_feature (472): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtggcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaatgtgaaagttataactattaacttttgactaaacttgaaaaaattcacatttttgntgtggaaccaaatctgatttgagaaccaagttgattttgatggattttgcaggagaatttagccacagaactcaccatcaaaatcatggacacattgagaaggatgaatcctgggttccagtatgtgattaactacttcctctatagttatttttgattcaattaaatttatttatttaataagttcaagaaaaaagggaatctttatacttcagataaagctgttcttgaacattttttttagtcattatcttag

SEQ ID NO: 3055 - DNA, 738 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacagcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttcgtcattatctagttaaccg

SEQ ID NO: 3056 - DNA, 794 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacactggtcggccacgggtttacacacgcgcacatcgttgcgttaagccaacacccggcagcgttttgcattcctcaattcttgtgccataccatggatggttagttcatcccggcttttttgtttgtcattggaagttctttattgattcaatttttatagcgtgttcggaaacgcgtttcagaaaataatgaaatacatcttgaatctgaaagttataacttttagcttcattgtcattgaaagttcttttataattatatttttattgcgtgtttggaatcccattgagaaataagaaatcacgtttaaatgtgaaagttataactattaacttttgactaaacttgaaaaaatcacattttgatgtggaaccaaatctgatttgagaaccaaagttgattttgatggattttgcaggagaatttagccacagaactcaccattcaaaatcatggacacattgagaaggatgaatcctgggttccagtaatgtgattaactacttcctctatagttatttttgattcaattaaatttatttatttaataagttcaagaaaaaggaatctttatacttcagataaagctgttcttgaacatttttttgtcattatcttagttaa

SEQ ID NO: 3057 - DNA, 670 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggatgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattatgccacagaactcaccatcaaaatcatggacacattgagaaggatgaatcctgggttccagtatgtgattaactacttcctctatagttatttttgattcaattaaatttatttatttaataagttcaagaaaaa

SEQ ID NO: 3058 - DNA, 616 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaaattatatttttattgcgtgtttggaatcccatttgagaaataagaaatcacgtttaaaaattgtgaaagttataactattaacttttgactaaacttgaaaaaactcacatttttgatgtggaaccaaaatctgattttgagaaccaagttgattttgatggattttgcaggagaattagccacagaactcaccatcaaaagtcatggacacattgagaaggatggaatcctgggttccagtatgtgattaactacttcctctatagttattttt

SEQ ID NO: 3059 - DNA, 703 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaaacttgaaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactaacttcctctatagttatttttgattcaattaaatttatttatttaataagttcaagaaaaaaggaatctttatacttcagataaagctgttc

SEQ ID NO: 3060 - DNA, 747 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcttcttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgattgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttctttgaacattttttttcgtcattatcttagttaacc

SEQ ID NO: 3061 - DNA, 441 bp, Artificial
  Glycine max FAD3A mutation created with TALEN pair GmFAD3_T02.1
  misc_feature (411): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcgagctcggtacctcgcgaatgcatctagatccaatgatcatgagcggagaattaagggagtcacgttatgacccccgccgatgacgcgggacaagccgttttacgtttggaactgacagaaccgcaacgttgaaggagccactcagccgcgggttttctggagttaatgagctaagcattcctcaattcttgtgccataccatggatggttagttcatccccggctttttttgtttgncattggaagttcttttattgattcaatttt

SEQ ID NO: 3062 - DNA, 637 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacaattcttgtgccataccatggatggttagttcatcccggctttttttgtttgtcattggaagttcttttattgattcaatttttatagcgtgttcggaaacgcgtttcagaaaataatgaaatacatcttgaatctgaaagttataacttttagcttcattgtcattgaaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaattta

SEQ ID NO: 3063 - DNA, 742 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttatacttcagataaagctgttcttgaacattttttttgtcattatctagttaaccgagaa

SEQ ID NO: 3064 - DNA, 737 bp, Artificial; identical to SEQ ID NO: 2869
  Glycine max FAD3A mutation created with TALEN pair GmFAD3_T02.1

SEQ ID NO: 3065 - DNA, 670 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacttgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagtatttttgattcaattaatttatttatttataagttcaagaaaaa

SEQ ID NO: 3066 - DNA, 604 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataactttttagcttcattgtcattgaaaagttcttttattaattatatttttattgcgtgtttggaatcccatttgagaaataagaaatcacgtttaaaaatgtgaaagttataactattaacttttgactaaaacttgaaaaaatcacatttttgatgtggaaccaaatctgattgagaaccaagttgattttgatggattttgcaggagaatttagccacagaactcaccatcaaaatcatggacacattgagaaggatgaatcctgggttccagtatgtgatt

SEQ ID NO: 3067 - DNA, 612 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatatttttattgcgtgtttggaatcccatttgagaaataagaaatcacgtttaaaatgtgaaagttataactattaacttttgactaaacttgaaaaaatcacatttttgatgtggaaccaaatctgattttgagaaccaagttgattttgatggattttgcaggagaattagccacagaactcaccatcaaaatcatggacacattgagaaggatgaatcctgggttccagtatgtgattaactacttcctctatagttattttga

SEQ ID NO: 3068 - DNA, 441 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacagcattcctcaattcttgtgccataccatggatggttagttcatcccggcttttttgtttgtcattggaagttcttttattgattcaatttttatagcgtgttcggaaacgcgtttcagaaaaattaatgaaaatacatcttgaatctgaaaagttataacttttagcttcattgtcattgaaagttcttttattaattatatttttattgcgtgtttggaatcccattgagaaataagaaatcacgttaaaaatgtgaaagttataacta

SEQ ID NO: 3069 - DNA, 597 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttcacaagctttccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaaagttctttttattaattatattttattgcgtgtttggaatcccatttgagaaataagaaatcacgtttaaaaattgtgaaagttataactattaacttttgactaaactgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttt

SEQ ID NO: 3070 - DNA, 637 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtggcttgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagtttgattttgatggattttgcaggagaattagccacagaactcaccatcaaaatcatggacacattgagaaggatgaatcctgggttccagtatgtgattaactacttcctctatagttatttttgattcaa

SEQ ID NO: 3071 - DNA, 685 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcggtttgcgtattgggcgctcttccgcttcctcgctcactgactcgctgcgctccctcgtgcgctctcctgttccgaccctgccgcttaccggatacctgtccgccttgcattcctcaattcttgtgccataccatggatggttagttcatcccggctttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatattttattgcgtgtttggaatcccatttgagaaataagaaatcacgtttaaaatgtgaaagttataactattaacttttgactaaaatcttgaaaaaaactcacatttttgatgtgggaaccaaaattctgattgagaaccaagttgatttgatggattttgcaggagaattagccacagaactcaccatcaaaatcatggacacattga

SEQ ID NO: 3072 - DNA, 477 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcaagccgtgggcctgggcacagcaccggcaacagccgctggaccgtctccagcgcctgcttgccaccgccattgctggcgatggccaccacctgctgggggggtcaagccgtgggcctggcacagcattgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattg

SEQ ID NO: 3073 - DNA, 727 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaatggaatctttatacttcagataaagctgttcttgaacattttttttcgtcattatct

SEQ ID NO: 3074 - DNA, 648 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggactcctcaattcttgtgccataccatggatggttagttcatcccggctttttttgtttgtcattggaagttcttttattgattcaatttttatagcgtgttcggaaacgcgtttcagaaaataatgaaatacatcttgaatctgaaaagttataactttttagcttcattgtcattgaaaagttcttttattaattatatttttattgcgtgtttggaatcccatttgagaaataagaaatcacgtttaaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttattta

SEQ ID NO: 3075 - DNA, 679 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacactattgctggcgatggccaccacctgctccggggtcaagccgtgggcctggcacagcaccggcaacagcgcctggaccgtctccagcgcctgcttgccaccaactcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgttggaatcccatttgagaaataagaaatcacgtttaaaatgtgaagttataactattaactttgactaaacttgaaaaaatcacatttttgatgtggaaccaaatctgatttgagaaccaagttgaattttgatggattttgcagggagaattagcccacagaactcaccatcaaaatcatggacacattgagaaggatgaat

SEQ ID NO: 3076 - DNA, 723 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggattgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaacctacttcctctatagttatttttgattcaattaatttatttatttaataagttcaagaaaaaggaatctttatacttcagataaagctgttcttgaacatttttgttttgtcatt

SEQ ID NO: 3077 - DNA, 736 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagtttcaagaaaaaggaatctttatacttcagataaagctgttcttgaacattttttttgtcattatcttagttaaccg

SEQ ID NO: 3078 - DNA, 637 bp, Artificial
  Glycine max FAD3A mutation created with TALEN pair GmFAD3_T02.1
  misc_feature (472): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggactcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaaataagaaatcacgtttaaaatgtgaaagttataactattaacttttgactaaacttgaaaaaattcacatttttgntgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttgattcaattaaa

SEQ ID NO: 3079 - DNA, 739 bp, Artificial
  Glycine max FAD3A mutation created with TALEN pair GmFAD3_T02.1
  misc_feature (684): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttattttatttaataagttcaagaaaaatggaatctttntacttcagataaagctgttcttgaacattttttttgtcattatctagttaaccga

SEQ ID NO: 3080 - DNA, 642 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtggcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataactttttagcttcattgtcattgaaaagttcttttattaattatatttttattgcgtgttttggaatcccatttgagaaataagaaatcacgtttaaaatgtgaaagttataactattaacttttgactaaacttgaaaaaattcacatttttgatgtggaaccaaatctgatttgagaacccaagttgatttttgatgggattttgcaggagaatttagcccacagaactcaccatcaaaattcatggacacattgagaaggatgaatcctgggttccagtatgtgattaactacttcctctatagttatttttcgattcaa

SEQ ID NO: 3081 - DNA, 645 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggagcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaactttttgactaaacttgaaaaaaactcacatttttgatgtggaaccaaatctgatttgagaaccaagttgattttgatggattttgcaggagaattagccacagaactcaccatcaaaaagtcatgggacacattgagaaggatgaatcctgggttccagtatgtgattaacctacttcctctatagttatttttcgattcaatt

SEQ ID NO: 3082 - DNA, 743 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagtttcaagaaaaataggaatctttataacttcagataaagcttgttcttgaacattttttttcgtcattatcttaagttaa

SEQ ID NO: 3083 - DNA, 736 bp, Artificial
  Glycine max FAD3A mutation created with TALEN pair GmFAD3_T02.1
  misc_feature (692): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttattttatttaataagttcaagaaaaatggaatctttatacttcaganaaagctgttcttgaacattttttttcgtcattatctagttaacc

SEQ ID NO: 3084 - DNA, 605 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaagagtgattcattcttcacattgaattgaacagtggccatggaagcttttcagacagcccttttctaaatagcctggtgggacacgcatttcctcaaatttcttgtgcccatacccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaaagttcttttattaattatatttttattgcgtgtttggaatcccatttgagaaataagaaatcacgtttaaaaatgtgaaagttataactattaacttttgactaaacttgaaaaaaatcacattttgatgtggaaccaaatctgatttgagaaccaagttgattttgatggattttgcaggagaattagccacagaactcaccatcaaaatcatggacacattgagaaggatgaatcctgggttccag

SEQ ID NO: 3085 - DNA, 714 bp, Artificial
  Glycine max FAD3A mutation created with TALEN pair GmFAD3_T02.1
  misc_feature (674): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaaagttataacttttagcttcattgtcattgaaagttcttttattaattatattttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgttcaattaaatttatttatttaataaagttcaagaaaaaggaanctttatacttcagataaagctgttcttgaacatttttttt

SEQ ID NO: 3086 - DNA, 738 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacatattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaattttattttatttaataagttcaagaaaaatggaatctttatacttcagataaagctgttcttgaacattttttttcgtcattatctagttaaccga

SEQ ID NO: 3087 - DNA, 436 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgtgggcctggcacagcaccggcaacagccgctgcaccgtctccagcgcctgcttgccaccaatattgctggcgatggccaccacctgctccggggtcaagccgtgggtcctggcacagcaccggcaacagcgcctgcaccgtctccagcgcctgcttgccaccaatattgctgcattcctcaattcttgtgcctataccatggatggttagttcattcccggcttttttgtttgtcattggaagttcttttattgattcaattttt

SEQ ID NO: 3088 - DNA, 696 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtggggtggtggccatcgccagcaatattggtggaactgaaaatggagtgcacatcacaaagattgaatcctcctcaattcttgtgccataccatggatggttagttcatcccggcttttttgtttgtcattggaagttcttttattgattcaatttttatagcgtgttcggaaaacgcgtttcagaaaataatgaaatacatcttgaatctgaaagttataacttttagcttcattgtcattgaaagttcttttattaattatatttttattgcgtgtttggaatcccattgagaaataagaaatcacgtttaaaatgtgaaagttataactattaacttttgactaaacttgaaaaaatcacattttgatgtggaaccaaatctgatttgagaaccaagttgatttgatggattttgcaggagaattagccacagaactcaccatcaaaatcatggacacattgagaaggtatgaatcctgggttccagtatgtgattaactaacttcctctatagttatttttgattcaatt

SEQ ID NO: 3089 - DNA, 564 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatccagcgcctgcttgccaccattattgctggcgatggccaccacctgctggggggtcaagccgtgggcctggcacagcaccggcaacagcgcctgcaccgtctccagcgcctgcttgccaccaatattgctggcgatggccaccacctgctccggggtcaagccgtgggcctggcacattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaat

SEQ ID NO: 3090 - DNA, 556 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcgctggagacggtccagcggctgttgccggtgctgtgccaggcccacggcttgaccccggagcaggtggtggccatcgccagccacgatggcggcaacagccgctggaccattcctcaattcttgtgccataccatggatggtttagttcatcccggcttttttgtttgtcattggaagttctttttattgattcaatttttatagcgtgttcggaaacgcgtttcagaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaactttt

SEQ ID NO: 3091 - DNA, 413 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacactgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttcagcttcattgtcattgaaagttcttttattaattatatttttaattgcgtgtttggaatcccatttgagaaataagaaa

SEQ ID NO: 3092 - DNA, 736 bp, Artificial
  Glycine max FAD3A mutation created with TALEN pair GmFAD3_T02.1
  misc_feature (681): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttataagttcaagaaaaatggaatctttntacttcagataaagctgttcttgaacattttttttcgtcattatctagttaaccg

SEQ ID NO: 3093 - DNA, 546 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacaaacattcctcaattcttgtgccataccatggatggttagttcatcccggctttttttgtttgtcattggaagttcttttattgattcaatttttatagcgtgttcggaaacgcgtttcagaaaaataatgaaaatacatcttgaatctgaaaagttataacttttagcttcattgtcattgaaaagttcttttattaattatattttttattgcgtgtttggaatcccatttgagaaataagaaatcacgtttaaaaatgtgaaagttataactattaacttttgactaaacttgaaaaaaatcacattttgatgtggaaccaaatctgatttgagaaccaaagttgattttgatggattttgcaggagaattag

SEQ ID NO: 3094 - DNA, 671 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacagcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgacgtaaacttgaaaaaatcacattttgatgtggaaccaaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaa

SEQ ID NO: 3095 - DNA, 628 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggagcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataactttttagcttcattgtcattgaaaagttcttttattaattatatttttattgcgtgtttggaatcccatttgagaataagaaatcacgtttaaaatgtgaaagttataactattaacttttgactaaacttgaaaaaatcacatttttgatgtggaaccaaatctgatttgagaccaagttgatttgatggattttgcaggagaattagccacagaactcaccatcaaaatcatggacacattgagaaggatgaatcctgggttccagtatgtgattaactacttcctctatagttattttgattcaa

SEQ ID NO: 3096 - DNA, 735 bp, Artificial
  Glycine max FAD3A mutation created with TALEN pair GmFAD3_T02.1
  misc_feature (680): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacagcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttntacttcagataaagctgttcttgaacattttttttcgtcattatctagttaaccg

SEQ ID NO: 3097 - DNA, 487 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacatgcattcctcaattcttgtgccataccatggatggttagttcatcccggcttttttgtttgtcattggaagttctttttattgattcaatttttatagcgtgttcggaaacgcgtttcagaaaattaatgaaaatacatcttgaatctgaaaagttataacttttagcttcattgtcattgaaagttcttttattaattatatttttatttgcgtgtttggaatcccatttgagaaataagaaatcacgtttaaaatgtgaaagttataactattaacttttgactaaacttgaaaaaactcacattttgatgtggaa

SEQ ID NO: 3098 - DNA, 741 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacttgcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaactttttgactaaacttgaaaaaaactcacatttttgatgtggaaccaaatctgatttgagaaccaagttgatttttgatggattttgcaggagaattagccacagaactcaccatcaaaatcatggacacattgagaaggatgaatcctgggttccagtatgtgattaactacttcctctatagttatttttgattcaattaaatttatttatttaataagtttcaagaaaaatggaatctttatacttcagataaagctgttcttgaacattttttttcgtcattatctagttaacc

SEQ ID NO: 3099 - DNA, 494 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagccctttttctaaatagcctggtgggacgcattcctcaattcttgtgccataccatggatggttagttcatcccggcttttttgtttgtcattggaagttcttttattgattcaatttttatagcgtgttcggaaacgcgtttcaggaaataatgaaaatacatcttgaatctgaaagttataacttttagcttcattgtcattgaaagttcttttattaattatattttttattgcgtgtttggaatcccatttgagaaataagaaatcacgtttaaaatgtgaagttataactattaacttttgactaaacttgaaaaaatcacattttgatgtggaaccaaatctgattt

SEQ ID NO: 3100 - DNA, 778 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacattgctggcgatggccaccacctgctccgggggtcaagccgtgggcctggcacagcaccggcaacagcgcctgcaccgtctcttgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaatcacatttttgatgtggaaccaaatctgatttgagaaccaagttgattttgatggattttgcaggagaattagccacagaactcaccatcaaaatcatggacacattgagaagggatgaatcctgggttccagtatgtgattaactacttcctctatagttatttttgattcaattaattttatttatttaataagttcaagaaaaaggaatctttatacttcagataaa

SEQ ID NO: 3101 - DNA, 712 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagtctggtgggcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgtttggaatcccatttgagaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaaaggaatctttatacttcagataaagctgttcttgaacatttttttt

SEQ ID NO: 3102 - DNA, 736 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaacttcaccatcaaaatcatggacacattgagaaggatgaatcctgggttccagtatgtgattaactacttcctctatagttatttttgattcaattaaatttatttatttaataagttcaagaaaaaggaatctttatacttcagaataaagctgttcttgaacattttttttgtcattatcttagttaaccg

SEQ ID NO: 3103 - DNA, 638 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacagcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaa

SEQ ID NO: 3104 - DNA, 736 bp, Artificial
  Glycine max FAD3A mutation created with TALEN pair GmFAD3_T02.1
  misc_feature (470): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtggttcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaaagttataacttttagcttcattgtcattgaaaagttcttttattaattatatttttattgcgtgttttggaatcccatttgagaaatagaaatcacgtttaaaatgtgaaagttataactattaacttttgactaaacttgaaaaaattcacatttttgntgttggaaccaaatctgatttgagaaccaagttgattttgatggattttgcaggagaatttagccacagaactcaccatcaaaatcatggacacattgagaaggatgaatcctgggttccagtatgtgattaactacttcctctatagttatttttcgattcaattaaatttatttatttaataagttcaagaaaaaaagggaatctttatacttcagataaagctgttcttgaacatttttttagtcattatcttagtaaccgag

SEQ ID NO: 3105 - DNA, 721 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacgcattcctcaattcttgtgccataccatggatggttagttcatcccggcttttttgtttgtcattggaagttctttttattgattcaatttttatagcgtgttcggaaacgcgtttcaggaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagtattttgattcaattaaatttatttattaataagttcaagaaaatgaatctttatacttcagataaagctgttcttgaacattttttttgtcattatct

SEQ ID NO: 3106 - DNA, 725 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacatcgccagcaatggcggtggcaagcaggcgctggagacggtccagcggctgttgccggtgctgtgcattcctcaattcttgtgccataccatggatggttagttcatcccggcttttttgtttgtcattggaagttcttttattgattcaatttttatagcgtgttcggaaacgcgtttcagaaaataatgaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttc

SEQ ID NO: 3107 - DNA, 732 bp, Artificial
  Glycine max FAD3A mutation created with TALEN pair GmFAD3_T02.1
  misc_feature (678): n is a or c or t or g
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacattcctcaattcttgtgccataccatggatggttagttcatcccggcttttttgtttgtcattggaagttcttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttntacttcagataaagctgttcttgaacatttttttcgtcattatctagttaaccg

SEQ ID NO: 3108 - DNA, 638 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacatgcattcctcaattcttgtgccataccatggatggttagttcatcccggcttttttgttttgtcattggaagttctttttattgattcaatttttatagcgtgttcggaaacgcgtttcagaaaataatgaaaatacatcttgaatctgaaagttataacttttagcttcattgtcattgaaagttcttttattaattatattttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactcttcctctatagttatttttgattcaa

SEQ ID NO: 3109 - DNA, 649 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggcggctccaggaagcccgacggcgccatctacaccgtgggctcccccatcgactacggcgtgatcgtggacaccaaggcctactccggcggctacaacctgcccatcggccaggccgacgaagcattcctcaattcttgtgccataccatggatggttagttcatcccggctttttgtttgtcattggaagttcttttattgattcaatttttatagcgtgttcggaaacgcgttcatcgaaaataatgaaatacatcttgaatctgaaagttataacttttagcttcattgtcattgaaagttcttttattaattatattttattgcgtgtttggaatccccatttgagaaataagaaattcacgtttaaaatgtgaaagttatactattaactttgactaaacttgaaaaatcacatttttgatgtggaaccaaatctgatttgagaaccaagttgattttgatggattttgcaggagaatt

SEQ ID NO: 3110 - DNA, 737 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaactcacattttgatgtggaaccaaatctgatttgagaaccaagttgattttgatggattttgcaggagaattagccacagaactcaccatcaaaagtcatggacacattgagaaggatgaatcctgggttccagtatgtgattaacctacttcctctatagttatttttgattcaattaaatttatttatttataagttcaagaaaaatggaatctttatacttcagataaagctgttcttgaacattttttttcgtcattatctagttaacc

SEQ ID NO: 3111 - DNA, 737 bp, Artificial; identical to SEQ ID NO: 2625
  Glycine max FAD3A mutation created with TALEN pair GmFAD3_T02.1
  misc_feature (682): n is a or c or t or g

SEQ ID NO: 3112 - DNA, 700 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacttgcattcctcaattcttgtgccataccatggatggttagttcatcccggcttttttgtttgtcattggaagttcttttattgattcaatttttatagcgtgttcggaaacgcgtttcagaaaaataatgaaatacatcttgaatctgaaagttataacttttagcttcattgtcattgaaagttcttttattaattatattttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaaggaatctttatacttcagataaagctg

SEQ ID NO: 3113 - DNA, 642 bp, Artificial
  Glycine max FAD3A mutation created with TALEN pair GmFAD3_T02.1
cactgctttgttatgcctacctcatttcatttggctttagacaacttaaatttgagatctttattatgtttttttgcttatatggtaaagtgattcattcttcacattgaattgaacagtggccatggaagcttttcagacagcccttttctaaatagcctggtgggagcattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatattttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttattttttgattcaattaa

SEQ ID NO: 3114 - DNA, 724 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacactcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacattttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttatttatttaataagttcaagaaaaatggaatctttataacttcagataaagctgttcttgaacattttttttgtcattatctag

SEQ ID NO: 3115 - DNA, 755 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacacgcattcctcaattcttgtgccataccatggatggttagttcatcccggctttttttgtttgtcattggaagttcttttattgattcaatttttatagcgtgttcggaaacgcgtttcagaaaaataatgaaatacatcttgaatctgaaaagttataacttttagcttcatttgtcattgaaagttcttttattaatttatattttttattgcgtgtttggaatcccatttgagaaataagaaatcacgtttaaaatgtgaaagttataactattaacttttgactaaacttgaaaaaatcacattttgatgtggaaccaaatctgatttgagaaccaagtttgattttgatggattttgcaggagaattagccacagaactcaccatcaaaatcatggacacattgagaaggatgaatcctgggttccattatgtgattaactacttcctctatagttattttttgattcaattaaattttattttattttaattaagttcaagaaaaatggaatctttataacttcagataaagctgttcttgaacatttttttttcgtcattattcttaagtttaacccgag

SEQ ID NO: 3116 - DNA, 730 bp, Artificial
  Glycine max FAD3A mutation created with TALEN pair GmFAD3_T02.1
cactgctttgttatgcctacctcatttcatttggctttagacaacttaaatttgagatctttattatgttttttgcttatatggtaaagtgattcattcttcacattgaattgaacagtggccatggaagcttttcagacagcccttttctaaatagcctggtgggacgattcctcaattcttgtgccataccatggatggttagttcatcccggcttttttgtttgtcattggaagttctttttattgattcaatttttatagcgtgttcggaaacgcgtttcagaaaataatgaaaatacatcttgaatctgaaagttataacttttagcttcattgtcattgaaagttcttttattaattatatttttattgcgtgtttggaatcccatttgagaaataagaaatcacgtttaaaatgtgaaagttataactattaacttttgactaaacttgaaaaaatcacatttttgatgtggaaccaaatctgatttgagaaccaagttgattttgatggattttgcaggagaattagccacagaactcaccatcaaaatcatggacacattgagaaggatgaatcctgggttccagtatgtgattaactacttcctctatagttatttttgattcaattaaatttattttatttaataagttcaagaaaaaaggaatctttatacttcagataaagctgttcttgaacattttttttgtcattatcttagtt

SEQ ID NO: 3117 - DNA, 446 bp, Artificial
  Glycine max FAD3B mutation created with TALEN pair GmFAD3_T02.1
ctcacacattgttctgttatgtcatttcttcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaaagggaatctttatgcttcctgaggctgttcttgaacatggctctttttatgtgtcattatcttagttaa

SEQ ID NO: 3118 - DNA, 444 bp, Artificial
  Glycine max FAD3B mutation created with TALEN pair GmFAD3_T02.1
ctcacacattgttctgttatgtcatttcttcttcatttgtcgttgcaagttcttttattggttaaattttatagcgtgctaggaaaccacttcgagaaaataagaaatcacatctggaatgtgaaagttataactgttagcttctgagtaaacgtggaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaaagggaatctttatgcttcctgaggctgttcttgaacatggctctttttatgtgtcattatcttagttaa

SEQ ID NO: 3119 - DNA, 445 bp, Artificial
  Glycine max FAD3B mutation created with TALEN pair GmFAD3_T02.1
ctcacacattgttctgttatgtcatttcttcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggatttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaaagggaatctttatgcttcctgaggctgttcttgaacatggctctttttatgtgtcattatcttagttaa

SEQ ID NO: 3120 - DNA, 446 bp, Artificial; identical to SEQ ID NO: 3117
  Glycine max FAD3B mutation created with TALEN pair GmFAD3_T02.1

SEQ ID NO: 3121 - DNA, 445 bp, Artificial
  Glycine max FAD3B mutation created with TALEN pair GmFAD3_T02.1
ctcacacattgttctgttatgtcatttcttcttcatttgtcgttgcaagttcttttattggttaaatttttatagcgtgctaggaaaccacttcgagaaaataagaaatcacatctggaatgtgaaagttataactgttagcttctgagtaaacgtggaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaaagggaatctttatgcttcctgaggctgttcttgaacatggctctttttatgtgtcattatcttagttaa

SEQ ID NO: 3122 - DNA, 444 bp, Artificial
  Glycine max FAD3B mutation created with TALEN pair GmFAD3_T02.1
ctcacacattgttctgttatgtcatttcttcttcatttgtcgttgcaagttcttttattggttaaatttttatagcgtgctaggaaaccattcgagaaaataagaaatcacatctggaatgtgaaagttataactgttagcttctgagtaaacgtggaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaaagggaatctttatgcttcctgaggctgttcttgaacatggctctttttatgtgtcattatcttagttaa

SEQ ID NO: 3123 - DNA, 773 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacagcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaaagggtaatctttatgcattcctgaggtctgttcttgaacatggctcttttttatgtgtca

SEQ ID NO: 3124 - DNA, 757 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacataccatggatggttagttcatactggcttttttgtttgttcatttgtcattgaaaaaaatcttttgttgattcaattattttatagtgtgtttggaagcccgtttgagaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggaatctttatgcattcctgaggtctgttcttgaacatggctcttttttagtgtcattatcttagttaa

SEQ ID NO: 3125 - DNA, 445 bp, Artificial; identical to SEQ ID NO: 3119
  Glycine max FAD3B mutation created with TALEN pair GmFAD3_T02.1

SEQ ID NO: 3126 - DNA, 599 bp, Artificial
  Glycine max FAD3B mutation created with TALEN pair GmFAD3_T02.1
ctcacacatttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtggggacacagtcatttcctcaattcttgtgccataccatggatggttagttcatactggcttttttgtttgttcatttgtcattgaaaaaaagtcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaccacattttggatttggaaccaaattttatttgataaatgacaaccaaattgattttgatggattttgcaaggagaattagccacagaactcaccatc

SEQ ID NO: 3127 - DNA, 771 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacaagcattcctcaattcttgtgccataccatggatggttagttcatactggcttttttgtttgttcatttgtcattgaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaaagggaatctttatgcttcctgaggctgttcttgaacatggctcttttttatgtgtca

SEQ ID NO: 3128 - DNA, 569 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacaatctttttgttgattcaattattttttatagtgtgtttggaagcccgtttgagaaaataagaaatcgcatctggaatgtgaaagttataactatttagcttcatttgtcgttgcaagttcttttattggttaaatttttatagcgtgctaggaaaacccattcgagaaaataagaatcacatctggaatgtgaaagttataactgttagcttctgagtaaacgtggaaaaaccacattttggatttggaaccaaatttatttgataaatgacaaccaaattgattttgatggattttgcaggagaattagccacagaactcaccatcaaaaatccatggacacattgagaaggatgagtcatgggttccagtatgtgatt

SEQ ID NO: 3129 - DNA, 771 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtcccaagaaaaaagggaatctttatgcattcctgaggctgttcttgaacatggctcttttttatgtgtca

SEQ ID NO: 3130 - DNA, 609 bp, Artificial
  Glycine max FAD3B mutation created with TALEN pair GmFAD3_T02.1
  misc_feature (438): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacttgcattcctcaattcttgtgccataccatggatggttagttcatactggcttttttgtttgttcatttgttcattgaaaaaaatcttttgttgattcaattaatttttatagtgtgtttggaagcccgtttgagaaaaataagaaatcgcatctggaatgtgaaaagttataactatttagcttcatttgtcgttgcaagttcttttattggttaaatttttatagcgtgcttaggaaaacccattcgngaaaataagaaatcatcatcatggaatgtgaaagttataactgttaagcttctgagtaaacgtggaaaaaccacattttggatttggaaccaaattttatttgataaatgacaaccaaattgattttgatggatttgcaggagaattagccacatgaactcaccatcaaaa

SEQ ID NO: 3131 - DNA, 485 bp, Artificial
  Glycine max FAD3B mutation created with TALEN pair GmFAD3_T02.1
ctcacacatttctgttatgtcatttcttcttcatttggctttagacaacttaaatttgagatctttattatgtttttgcttatatggtaaagtgattcttcattatttcattcttcattgattgaattgaacagtggccatggaagcttttcagatagcccctttgctgaatagcctggtggggacacagtcatttcctcaattcttgtgccataccatggatggttagttcatactggcttttttgtttgttcatttgtcattgaaaaaaatcttttgttgattcaattatttttatagtgtgttttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaatcacatctggaatgtgaaagttataactgttagcttct

SEQ ID NO: 3132 - DNA, 781 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggaatctttatgcttcctgaggctgttcttgaacatggctcttttttatgtgtcatttatcttagttaa

SEQ ID NO: 3133 - DNA, 779 bp, Artificial
  Glycine max FAD3B mutation created with TALEN pair GmFAD3_T02.1
  misc_feature (685): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggggcattcctcaattcttgtgccataccatggatggttagttcatactggctttttttgtttgttcatttgtcattgaaaaaaaatcttttgttgattcaattatttttatagtgtgtttggaagcccgtttgagaaaaattaagaaatcgcatctggaatgtgaaaagttataactatttagcttcatttgtcgttgcaagtttcttttattggttaaatttttatagcgtgctaggaaacccattcgagaaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattanattttatttatttggtaggtccaagaaaaaagggaatctttatgcattcctgaggtctgttcttgaacatggctcttttttatgtgtcattatc

SEQ ID NO: 3134 - DNA, 768 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacttgcattcctcaattcttgtgccataccatggatggttagttcatactggcttttttgtttgttcatttgtcattgaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaaattacatttttatttatttgggtagggtcccaagaaaaagggtaatctttatgcattcctgaggctgttcttgaacatggctctttttt

SEQ ID NO: 3135 - DNA, 569 bp, Artificial
  Glycine max FAD3B mutation created with TALEN pair GmFAD3_T02.1
ctcacacattgttctgttatgtcatttcttcttcatttggctttagacaatcttaaatttgagatctttattatgtttttgcttatatggtaaagtgattcttcattatttcattcttcattgattgaattgaacagtggccatggaagcttttcagatagccctttgctgaatagcctggtgggacacatccagcggctgttgccggtgctgtgccaggcccacggcttgaccccccaggtggtggccatcgccagcaataatggtggcaagcaggcgctggaaattcctcaattcttgtgccataccatggatggttagttcatactggcttttttagtttgttcatttgtcattgaaaaaaagtcttttgttgattcaattattttatagtgtgtttggaagcccgtttgagaaaaataagaaatcgcatctggaatgtgaaagttataactatttagcttcatttgtcgttgcaagttctttattggttaaatttttgatagcgtgctaggaaacccaattcgagaaaataagaaatcacatctggaatgtgaaagttataactg

SEQ ID NO: 3136 - DNA, 753 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggaatctttatgcttcctgaggctgttcttgaacatggctctttttt

SEQ ID NO: 3137 - DNA, 771 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacgcattcctcaattcttgtgccataccatggatggttagttcatactggcttttttgtttgttcatttgtcattgaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtcccaagaaaaaagggaatctttatgcattcctgaggctgttcttgaacatggctctttttatgtgtca

SEQ ID NO: 3138 - DNA, 622 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggaaatcgcatctggaatgtgaaagttataactatttagcttcatttgtcgttgcaagttcttttattggttaaattttatagcgtgctaggaaacccattcgagaaaataagaaatcacatctggaatgtgaaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaagggatgagtcatgggttccagtatgtgattaattgcttctcctatagttgttcttgattcaattacattttattttatttggtaggtccaagaaaaaaagggaatctttatgcttcctgaggctgttcttgaacatggctctttttatgtgtc

SEQ ID NO: 3139 - DNA, 792 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaaccatggacacattgagaaggatgagtcatgggttccagtatgtgattaattgcttctcctatagttgttcttgattcaattacattttatttatttggtagggtccaagaaaaaagggtaatctttatgcattcctgaggctgttcttgaacatggctcttttttaatgtgtcatttatcttagttaa

SEQ ID NO: 3140 - DNA, 786 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggatgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtcccaagaaaaaaagggtaatcttttatgcttcctgaggctgttcttgaacatggctcttttttatgtgtcatatcttagttaa

SEQ ID NO: 3141 - DNA, 447 bp, Artificial
  Glycine max FAD3B mutation created with TALEN pair GmFAD3_T02.1
ctcacacattgttctgttatgtcatttcttcttcatttgtcgttgcaagttcttttattggttaaatttttatagcgtgctaggaaacccacttcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaaagggaatctttatgcttcctgaggctgttcttgaacatggctctttttatgtgtcattatcttagttaa

SEQ ID NO: 3142 - DNA, 675 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattatttcattcctcaattcttgtgccataccatggatggttagttcatactggcttttttgtttgttcatttgtcattgaaaaaaatcttttgttgattcaattatttttatagtgtgtttggaagcccgtttgagaaaataagaaatcgcatctggaatgtgaaagttataactatttagcttcatttgtcgttgcaagttcttttattggttaaatttttatagcgtgctaggaaaacccattcgagaaaataagaaatcacatctggaatgtgaaagttataactgttagcttctgagtaaacgtggaaaaaaccacattttggatttggaaccaaattttatttgataaatgacaaccaaattgattttgatggattttgcaggagaattagccacagaactcaccatcaaaaaccatggacacattgagaaggatgagtcatgggttccagtatgtgattaattgcttctcctatagttgttcttgattcaattacattttatttatttggtaggtccaagaaaaaagggaatctttatgcttcctgaggc

SEQ ID NO: 3143 - DNA, 700 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcctcaattcttgtgccataccatggatggttagttcatactggcttttttgtttgttcatttgtcattgaaaaaatcttttgttgattcaattatttttatagtgtgtttggaagcccgtttgagaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaacttcaccatcaaaaaccatggacacattgagaaggatgagtcatgggttccagtatgtgattaattgcttctcctatagttgttcttgattcaattacattttatttatttggtaggtccaagaaaaaagggaatctttatgcttcctgaggctgttcttgaacatggctcttttttatgtgtcattatcttagtt

SEQ ID NO: 3144 - DNA, 772 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacagcattcctcaattcttgtgccataccatggatggttagttcatactggcttttttgtttgttcatttgtcattgaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaaagggtaatctttatgcattcctgaggctgttcttgaacatggctcttttttatgtgtca

SEQ ID NO: 3145 - DNA, 781 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggaatctttatgcattcctgaggctgttcttgaacatggctcttttttatgtgtcatttatcttagttaa

SEQ ID NO: 3146 - DNA, 778 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacgcattgcctccattcattgttgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttgggtagggtcccaagaaaaaaagggaatctttatgcattcctgaggctgttcttgaacatggctcttttttatgtgtca

SEQ ID NO: 3147 - DNA, 783 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggaccattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggtaatctttatgcattcctgaggctgttcttgaacatggctcttttttatgtgtcatttatcttagttaa

SEQ ID NO: 3148 - DNA, 778 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtttgcattcctcaattcttgtgccataccatggatggttagttcatactggcttttttgtttgttcatttgtcattgaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaagggaatctttatgcattcctgaggctgttcttgaacatggctcttttttatgtgtcattatcttagttaa

SEQ ID NO: 3149 - DNA, 781 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacagtgcattcctcaattcttgtgccataccatggatggttagttcatactggcttttttgtttgttcatttgtcattgaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtcccaagaaaaaagggtaatctttatgcttcctgaggctgttcttgaacatggctcttttttatgtgcattatcttag

SEQ ID NO: 3150 - DNA, 764 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggtttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaaagggtaatctttatgcattcctgaggctgttcttgaacatggctctttttt

SEQ ID NO: 3151 - DNA, 764 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggaatctttatgcattcctgaggctgttcttgaacatggctctttttt

SEQ ID NO: 3152 - DNA, 690 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacgcattcctcaattcttgtgccataccatggatggttagttcatactggcttttttgtttgttcatttgtcattgaaaaaaagtcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaacccaaaatttttgattttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattaca

SEQ ID NO: 3153 - DNA, 868 bp, Artificial
  Glycine max FAD3B mutation created with TALEN pair GmFAD3_T02.1
  misc_feature (809): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacagtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggatggttagttcatactggctttttgtttgttcattgtcattgaaaaaaatcttttgttgattcaattattttatagtgtgtttggaagcccgtttgagaaataagaaatcgcatctggaatgtgaaagttataactatttagcttcatttgtcgttgcaagttcttttattggttaattttattagcgtgctaggaaacccattcgagaaaataagaaatcacatctggaatgtgaaagttataactgttagcttctgagtaaacgtggaaaaaccacattttggatttggaaccaaatttttattttgataaatgacaaccaaattgattttgatggattttgcaaggagaattagccacagaactcaccatcaaaaatccatggacacattgagaaggatgagtcatgggttccagtatgtgattaattgcttctcctatagttgttcttgattcaattacattttntttattttggtaggtccaaagaaaaaatgggaatctttatgcttcctgaggctgttctt

SEQ ID NO: 3154 - DNA, 719 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacactgcattgccttccattcattgttgcgcataccatggatggttagttcatactggcttttttgtttgttcatttgtcattgaaaaaaatcttttgttgattcaattatttttatagtgtgtttggaagcccgtttgagaaaaattaagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaa

SEQ ID NO: 3155 - DNA, 679 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacagcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattc

SEQ ID NO: 3156 - DNA, 554 bp, Artificial
  Glycine max FAD3B mutation created with TALEN pair GmFAD3_T02.1
ctcacacattttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtggggacacagtcatttcctcaattcttgtgccataccatggatggttagttcatactggcttttttgtttgttcatttggtcattgaaaaaaaagtcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaccacattttggatttggaaccaaattttatttgtataaatgacaaccaaa

SEQ ID NO: 3157 - DNA, 767 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacattcctcaattcttgtgccataccatggatggttagttcatactggcttttttgtttgttcatttgtcattgaaaaaaaagtcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttgatttgataaatgacaaccaaattgattttgatggattttgcaggagaattagccacagaactcaccatcaaaaagccatggacacattgagaaggatgagtcatgggttccagtatgtgattaattgcttctcctatagttgttcttgattcaattacattttatttatttggtagggtccaagaaaaaaatgggaatctttatgcttcctgaggctgttcttgaacatggctctttttt

SEQ ID NO: 3158 - DNA, 718 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacgcattgccttccattcattgttgcgcataccatggatggttagttcatactggcttttttgtttgttcatttgtcattgaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaagccatggacacattgagaaggatgagtcatgggttccagtatgtgattaattgcttctcctatagttgttcttgattcaattacattttatttatttggtaggtccaagaaaaa

SEQ ID NO: 3159 - DNA, 446 bp, Artificial; identical to SEQ ID NO: 3117
  Glycine max FAD3B mutation created with TALEN pair GmFAD3_T02.1

SEQ ID NO: 3160 - DNA, 788 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacaagcattcctcaattcttgtgccataccatggatggttagttcatactggcttttttgtttgttcatttgtcattgaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtcccaagaaaaaagggtaatctttatgcattcctgaggctgttcttgaacatggctcttttttatgtgtcattatctagttaa

SEQ ID NO: 3161 - DNA, 745 bp, Artificial
  Glycine max FAD3B mutation created with TALEN pair GmFAD3_T02.1
  misc_feature (297): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtggggacactgcatttgccttccattcattgttgcgcataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggaatctttatgcattcctgagg

SEQ ID NO: 3162 - DNA, 783 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttatttgataaatgacaaccaaattgattttgatggattttgcaggagaattagccacagaactcaccatcaaaaccatggacacattgagaaaggatgagtcatgggttccagtatgtgattaattgcttctcctatagttgttcttgattcaattacattttatttatttggtagggtccaagaaaaagggtaatctttatgcattcctgaggtctgttcttgaacatggctcttttttatgtgtcattatcttagttaa

SEQ ID NO: 3163 - DNA, 695 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtttcttgtgccataccatggatggttagttcatactggcttttttgtttgttcatttgtcattgaaaaaaactcttttgttgattcaattatttttatagtgtgtttggaagcccgtttgagaaaattaagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaa

SEQ ID NO: 3164 - DNA, 708 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacagcattcctcaattcttgtgccataccatggatggttagttcatactggcttttttgtttgttcatttgtcattgaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccc

SEQ ID NO: 3165 - DNA, 774 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatgcattcctcaattcttgtgccataccatggatggttagttcatactggcttttttgtttgttcatttgtcattgaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaagggaatctttatgcattcctgaggtctgttcttgaacatggctcttttttatgtgtca

SEQ ID NO: 3166 - DNA, 784 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaaagggtaatctttatgcattcctgaggctgttcttgaacatggctcttttttatgtgtcatttatcttagttaa

SEQ ID NO: 3167 - DNA, 694 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacattcctcaattcttgtgccataccatggatggttagttcatactggcttttttgtttgttcatttgtcattgaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggta

SEQ ID NO: 3168 - DNA, 790 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacagcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattatcattttattaagtttggtagggtccaatgaaaaacgggtaaatcttttatgcattccttgaggtctgtttcttgaacatggctcttttttaatgtgtcattatcta

SEQ ID NO: 3169 - DNA, 775 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtttgcattcctcaattcttgtgccataccatggatggttagttcatactggctttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaaatttttatagcgtgctaggaaaacccattcgagaaaaataagaaatcacatctggaatgtgaaagttataactgttagcttctgagtaaacgtggaaaaaccacattttggatttggaaccaaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaaaagggtaatctttatgcattcctgaggctgttcttgaacatggctcttttttatgtgtca

SEQ ID NO: 3170 - DNA, 764 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacagtgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggaatctttatgcattcctgaggctgttcttgaacatggctctttttt

SEQ ID NO: 3171 - DNA, 700 bp, Artificial
  Glycine max FAD3B mutation created with TALEN pair GmFAD3_T02.1
ctcacacattgttctgttatgtcatttcttcttcatttggctttagacaacttaaatttgagatctttattatgttttttgcttatatggtaaagtgattcttcattatttcattcttcattgattgaattgaacagtggccatggaagcttttcagatagccctttgctgaatagcctggtgggacagcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggta

SEQ ID NO: 3172 - DNA, 706 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcctcaattcttgtgccataccatggatggttagttcatactggcttttttgtttgttcatttgtcattgaaaaaaatcttttgttgattcaattatttttatagtgtgtttggaagcccgtttgagaaaataagaaatcgcatctggaatgtgaaagttataactatttagcttcatttgtcgttgcaagttcttttattggttaaatttttatagcgtgctaggaaaacccattcgagaaaataagaaatcacatctggaatgtgaaagttataactgttagcttctgagtaaacgtggaaaaaaccacattttggattttggaaccaaattttatttgataaatgacaaccaaattgattttgatggattttgcaggagaattagccaaaagaactcaccatcaaaaccatggacacattgagaaggatgagtcatgggttccagtatgtgattaattgcttctcctatagttgttcttgattcaattacattttatttatttggtaggtccaagaaaaaaaggggaatctttatgcttcctgaggctgttcttgaacatggctcttttttatgtgtcattatcttagtt

SEQ ID NO: 3173 - DNA, 772 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggcattcctcaattcttgtgccataccatggatggttagttcatactggcttttttgtttgttcatttgtcattgaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatggcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtcccaagaaaaaagggtaatctttatgcattcctgaggctgttcttgaacatggctcttttttatgtgtcattt

SEQ ID NO: 3174 - DNA, 760 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggaccattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaaagggaatctttatgcttcctgaggctgttcttgaacatggctctttttt

SEQ ID NO: 3175 - DNA, 789 bp, Artificial
  Glycine max FAD3B mutation created with TALEN pair GmFAD3_T02.1
  misc_feature (295): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtggggacactgcattgccttccattcattgttgcgcataccatggatggttagttcatactggcttttttgtttgttcatttgtcattgaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttgggtaggtccaagaaaaagggaatctttatgcttcctgaggctgttcttgaacatggctcttttttatgtgtcattatcttagttaa

SEQ ID NO: 3176 - DNA, 764 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacgcattcctcaattcttgtgccataccatggatggttagttcatactggctttttttgtttgttcatttgtcattgaaaaaaaatcattttgttgattcaattatttttattagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggaatctttatgcattcctgaggctgttcttgaacatggctctttttt

SEQ ID NO: 3177 - DNA, 673 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtggggacattgcattcctcaattcttgtgccataccatggatggttagttcatactggcttttttgtttgttcatttgtcattgaaaaaaaatcttttgttgattcaattatttttatagtgtgttttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttc

SEQ ID NO: 3178 - DNA, 770 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacactgtcatttgccattccattcattgcttgcgcataccatggatggttagttcatactggcttttttgtttgttcatttgtcattgaaaaaaaatcttttgttgttcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggaatctttatgcttcctgaggctgttcttgaacatggctcttttt

SEQ ID NO: 3179 - DNA, 769 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaagggtaatctttatgcattcctgaggctgttcttgaacatggctcttttttatgtgtca

SEQ ID NO: 3180 - DNA, 784 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacactgcattcctcaattcttgtgccataccatggatggttagttcatactggcttttttgtttgttcatttgtcattgaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaaagggaatctttatgcttcctgaggctgttcttgaacatggctcttttttatgtgtcattatcttagttaa

SEQ ID NO: 3181 - DNA, 789 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaaagggtaatctttatgcattcctgaggctgttcttgaacatggctcttttttatgtgtcatttatcttagttaa

SEQ ID NO: 3182 - DNA, 768 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagccttcctcaattcttgtgccataccatggatggttagttcatactggcttttttgtttgttcatttgtcattgaaaaaaatcttttgttgattcaattatttttatagtgtgtttggaagcccgtttgagaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtgaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaaagggaatctttatgcttcctgaggctgttcttgaacatggctcttttttatgtgtcattatcttagttaa

SEQ ID NO: 3183 - DNA, 775 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtggggacactgcattcctcaattcttgtgccataccatggatggttagttcatactggcttttttgtttgttcatttgtcattgaaaaaaaatcttttgttgattcaattatttttatagtgtgtttggaagcccgtttgagaaaaattaagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttaatttatttggtagggtccaagaaaaaaagggaatctttagcttccgaggctgttcttgaacatggctcttttttatgtgcatt

SEQ ID NO: 3184 - DNA, 770 bp, Artificial
  Glycine max FAD3B mutation created with TALEN pair GmFAD3_T02.1
ctcacacattgttctgttatgtcaatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaaaagggtaatctttatgcattcctgaggctgttcttgaacatggctcttttttatgtgtca

SEQ ID NO: 3185 - DNA, 768 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacagcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaaagggtaatctttatgcattcctgaggtctgttcttgaacatggctctttttt

SEQ ID NO: 3186 - DNA, 671 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcctcaattcttgtgccataccatggatggttagttcatactggcttttttgtttgttcatttgtcattgaaaaaaatcttttgttgattcaattatttttatagtgtgtttggaagcccgtttgagaaaataagaaatcgcatctggaatgtgaaaagttataactatttagcttcatttgtcgttgcaagttcttttattggttaaatttttatagcgtgctaggaaaacccattcgagaaaataagaaatcacatctggaatgtgaaagttataactgttagcttctgagtaaacgtggaaaaaaccacattttggatttggaaccaaattttatttgataaatgacaaccaaattgattttgatggattttgcaggagaattagccacagaactcaccatcaaaaaccatggacacattgagaaggatgagtcatgggttccagtatgtgattaattgcttctcctatagttgttcttgattcaattacattttatttatttggtaggtccaagaaaaaaaggggaatctttatgcttcctgaggctgttcttg

SEQ ID NO: 3187 - DNA, 698 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacagcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttattt

SEQ ID NO: 3188 - DNA, 771 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacattcctcaattcttgtgccataccatggatggttagttcatactggcttttttgtttgttcatttgtcattgaaaaaaaatcttttgttgattcaattatttttatagtgtgtttggaagcccgtttgagaaaaattaagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaagccatggacacattgagaaggatgagtcatgggttccagtatgtgattaattgcttctcctatagttgttcttgattcaattacattttatttatttggtagggtccaagaaaaagggaatctttatgcattcctgaggtcttgttcttgaacatggctcttttttatgtgtca

SEQ ID NO: 3189 - DNA, 702 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacaatcttttgttgattcaattatttttatagtgtgtttggaagcccgtttgagaaaataagaaatcgcatctggaatgtgaaagttataactatttagcttcatttgtcgttgcaagttcttttattggttaaatttttatagcgtgctaggaaacccattcgagaaaataagaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaaccatggacacattgagaaggatgagtcatgggttccagtatgtgattaattgcttctcctatagttgttcttgattcaattacattttatttatttggtaggtccaagaaaaaaaggggaatctttatgcttcctgaggctgttcttgaacatggctcttttttatgtgtcattatcttagtt

SEQ ID NO: 3190 - DNA, 759 bp, Artificial
  Glycine max FAD3B mutation created with TALEN pair GmFAD3_T02.1
ctcaacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagccttgcattcctcaattcttgtgccataccatggatggttagttcatactggcttttttgtttgttcatttgtcattgaaaaaaatcttttgttgattcaattatttttatagtgtgtttggaagcccgtttgagaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaagggaatctttatgcattcctgaggctgttcttgaacatggctcttttttatgtgtca

SEQ ID NO: 3191 - DNA, 785 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacactagcattcctcaattcttgtgccataccatggatggttagttcatactggcttttttgtttgttcatttgtcattgaaaaaaaagtcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgatccaattacattttatttatttggtagggtccaagaaaaaaatgggaatcttttatgcttcctgaggctgttcttgaacatggctcttttttatgtgcattatcttag

SEQ ID NO: 3192 - DNA, 790 bp, Artificial
  Glycine max FAD3B mutation created with TALEN pair GmFAD3_T02.1
  misc_feature (297): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtggggacactgcatttgccttccattcattgttgcgcataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggaatctttatgcttcctgaggctgttcttgaacatggctcttttttatgtgtcattatcttagttaa

SEQ ID NO: 3193 - DNA, 786 bp, Artificial
  Glycine max FAD3B mutation created with TALEN pair GmFAD3_T02.1
  misc_feature (297): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtggggacactgtcattgccttccattcattgttgcgcataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaatgggaatctttatgcttcctgaggctgttcttgaacatggctcttttttatgtgcattatcttag

SEQ ID NO: 3194 - DNA, 759 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacataccatggatggttagttcatactggcttttttgtttgttcatttgtcattgaaaaaaatcttttgttgattcaattatttttatagtgtgtttggaagcccgtttgagaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggaatctttatgcattcctgaggtctgttcttgaacatggctcttttttatgtgtcattatcttagttaa

SEQ ID NO: 3195 - DNA, 762 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcctcaattcttgtgccataccatggatggttagttcatactggcttttttgtttgttcatttgtcattgaaaaaaaagtcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaaatgggaatctttatgcttcctgaggctgttcttgaacatggctctttttt

SEQ ID NO: 3196 - DNA, 722 bp, Artificial
  Glycine max FAD3B mutation created with TALEN pair GmFAD3_T02.1
  misc_feature (261): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttcctcaattcttgtgccataccatggatggttagttcatactggcttttttgtttgttcatttgtcattgaaaaaaatcttttgttgattcaattntttttatagtgtgtttggaagcccgtttgagaaaataagaaatcgcatctggaatgtgaaagttatactatttagcttcatttgtcgttgcaagttcttttattggttaaaatttttatagcgtgctaggaaaacccattcgagaaaaataagaaatcacatctggaatgtgaaagttataactgttagcttctgagtaaacgtggaaaaaccacatttttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacatttttatttatttggtaggtccaagaaaaagggaatctttatgcttcctgaggctgttcttgaa

SEQ ID NO: 3197 - DNA, 786 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacagcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaagggtaatctttatgcattcctgaggctgttcttgaacatggctctttttatgtgtcatttatcttagttaa

SEQ ID NO: 3198 - DNA, 635 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggaaatcgcatctggaatgtgaaagttataactatttagcttcatttgtcgttgcaagttcttttattggttaaatttttatagcgtgctaggaaacccattcgagaaaataagaaatcacatctggaatgtgaaaagttataactgttagcttctgagtaaacgtggaaaaaaccacattttggatttggaaccaaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaaaagggaatctttatgcttcctgaggctgttcttgaacatggctctttttatgtgtcattatcttagtt

SEQ ID NO: 3199 - DNA, 689 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacgcattgccttccattcattgttgcgcataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattaca

SEQ ID NO: 3200 - DNA, 795 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaaacccattcgagaaaaataagaaatcacatctggaatgtgaaagttataactgttagcttctgagtaaacgtggaaaaaccacattttggatttggaaccaaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacatttttatttatttggtagggtccaaagaaaaaaagggtaatctttatgcattcctgaggctgttcttgaacatggctcttttttaatgtgtcatttatcttagttaa

SEQ ID NO: 3201 - DNA, 785 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggtgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttatttgataaatgacaaccaaattgattttgatggattttgcaggagaattagccacagaactcaccatcaaaaccatggacacattgagaaaggatgagtcatgggttccagtatgtgattaattgcttctcctatagttgttcttgattcaattacattttatttatttggtaggtccaagaaaaagggtaatctttatgcattcctgaggctgttcttgaacatggctcttttttatgtgtcatttatcttagttaa

SEQ ID NO: 3202 - DNA, 691 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacagcattgccttccattcattgttgcgcataccatggatggttagttcatactggcttttttgtttgttcatttgtcattgaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaagccatggacacattgagaaggatgagtcatgggttccagtatgtgattaattgcttctcctatagttgttcttgattcaaattaca

SEQ ID NO: 3203 - DNA, 720 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacagcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacatttttatttatttggtagggtcccaaagaaaaaaa

SEQ ID NO: 3204 - DNA, 730 bp, Artificial
  Glycine max FAD3B mutation created with TALEN pair GmFAD3_T02.1
  misc_feature (296): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacactgcattgccttccattcattgttgcgcataccatggatggttagttcatactggcttttttgtttgttcatttgtcattgaaaaaaaagtcttttgttgattcaattntttttatagtgtgtttggaagcccgtttgagaaaaattaagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttgatttgataaatgacaaccaaattgattttgatggattttgcaggagaattagccacagaactcaccatcaaaagccatggacacattgagaaggatgagtcatgggttccagtatgtgattaattgcttctcctatagttgttcttgattcaattacattttatttatttggtaggtccaagaaaaaatgggaa

SEQ ID NO: 3205 - DNA, 788 bp, Artificial
  Glycine max FAD3B mutation created with TALEN pair GmFAD3_T02.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacactgcattgccttccattcattgttgcgcataccatggatggttagttcatactggcttttttgtttgttcatttgtcattgaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaagggaatctttatgcttcctgaggctgttcttgaacatggctcttttttatgtgtcattatcttagttaa

SEQ ID NO: 3206 - DNA, 768 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtcccaagaaaaagggtaatctttatgcattcctgaggtctgttcttgaacatggctctttttt

SEQ ID NO: 3207 - DNA, 775 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacagcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaaagggtaatctttatgcattcctgaggtctgttcttgaacatggctcttttttatgtgtca

SEQ ID NO: 3208 - DNA, 686 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattaca

SEQ ID NO: 3209 - DNA, 775 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggaccattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggtaatctttatgcattcctgaggtctgttcttgaacatggctctttttatgtgtcattatc

SEQ ID NO: 3210 - DNA, 768 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacatcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggtaatctttatgcattcctgaggtctgttcttgaacatggctcttttttatgtgtca

SEQ ID NO: 3211 - DNA, 792 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtggggacacatcgcatttgccattccattcattgttgcgcataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggaatctttatgcttcctgaggctgttcttgaacatggctcttttttatgtgcattatcttagttaa

SEQ ID NO: 3212 - DNA, 738 bp, Artificial
  Glycine max FAD3B mutation created with TALEN pair GmFAD3_T02.1
  misc_feature (598): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacaacggtccagcggctgttgccggtgctgtgccaggcccacggcttgaccccccagcaggtggcattcctcaattcttgtgccataccatggatggttagttcatactggctttttgtttgttcatttgtcattgaaaaaatcttttgtgatttcaaattatttttatagtgttgtttggaagcccgtttgagaaaatagaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttgggatttggaaccaaaatttatttgataaatgncaaccaaattgatttgatggatttgcaggagaattagccacagaatctcaccatcaaaatccatggacacattgagaaggatgagtcatgggttccagtatgtgatttaattgcttctcctatagttgttcttgattcaa

SEQ ID NO: 3213 - DNA, 777 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacaattcttgtgccataccatggatggttagttcatactggcttttttgtttgttcatttgtcattgaaaaaaatcttttgttgattcaattatttttatagtgtgtttggaagcccgtttgagaaaataagaaaatcgcatctggaatgtgaaaagttataactatttagcttcatttgtcgttgcaagttcttttattggttaaaatttttatagcgtgctaggaaaacccattcgagaaaataagaaatcacatctggaatgtgaaagttataactgttagcttctgagtaaacgtggaaaaaccacattttggatttggaaccaaaattttatttgataaatgacaaccaaattgattttgatggattttgcaggagaattagccacagaactcaccatcaaaaaccatggacacattgagaaaggatgagtcatgggttccagtatgtgattaattgcttctcctatagttgttcttgattcaattacattttatttatttggtaggtccaagaaaaagggaatctttatgcattcctgaggctgttcttgaacatggctcttttttatgtgtcattatcttagttaa

SEQ ID NO: 3214 - DNA, 785 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacgcattcctcaattcttgtgccataccatggatggttagttcatactggcttttttgtttgttcatttgtcattgaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtcccaagaaaaagggaatctttatgcattcctgaggctgttcttgaacatggctcttttttatgtgtcatttatcttagttaa

SEQ ID NO: 3215 - DNA, 785 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttatttgataaatgacaaccaaattgattttgatggattttgcaggagaattagccacagaactcaccatcaaaaccatggacacattgagaaaggatgagtcatgggttccagtatgtgattaattgcttctcctatagttgttcttgattcaattacattttatttatttggtagggtccaagaaaaaagggtaatctttatgcattcctgaggtctgttcttgaacatggctcttttttatgtgtcattatcttagttaa

SEQ ID NO: 3216 - DNA, 763 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaaagaaaaaaagggaatctttatgcattcctgaggctgttcttgaacatggctctttttt

SEQ ID NO: 3217 - DNA, 775 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggactcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcgggagaattagccacagaactcaccatcaaaaccatggacacattgagaaggatgagtcatgggttccagtatgtgattaattgcttctcctatagttgttcttgattcaattacattttatttatttggtagggtccaagaaaaaagggaatctttatgcttcctgaggctgttcttgaacatggctcttttttatgtgtcattatcttagttaa

SEQ ID NO: 3218 - DNA, 778 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaaagggtaatctttatgcattcctgaggctgttcttgaacatggctcttttttatgtgtcattt

SEQ ID NO: 3219 - DNA, 789 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacatattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaaacccattcgagaaaataagaaatcacatctggaatgtgaaagttataactgttagcttctgagtaaacgtggaaaaaccacattttggatttggaaccaaaattttatttgataaatgacaaccaaattgattttgatggattttgcaggagaattagccacagaactcaccatcaaaaccatggacacattgagaaaggatgagtcatgggttccagtatgtgattaattgcttctcctatagttgttcttgattcaattacatttttatttatttggtagggtccaagaaaaagggtaatctttatgcattcctgaggtctgttcttgaacatggctcttttttatgtgtcattatcttagttaa

SEQ ID NO: 3220 - DNA, 736 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggctgcatcctcaattcttgtcgtccatcaatcctgatggcatgctagttcgatgtgtctactggctttttttgtttgttcatttgtcattgaaaaaaaagtcttttgttgattcaattatttttatagtgtgtttggaagcccgtttgagaaaaataagaaatcgcatctggaatgtgaaagttataactatttagcttcatttgtcgttgcaagttcttttattggttaaattttttatagcgtgctaggaaacccattcgagaaaataagaaatcacatctggaatgtgaaagttataactgttagcttctgagtaaacgtggaaaaaccacattttggatttggaaaccaaaatttttattttgataaatgacaaccaaattgattttgatggattttgcaggagaattagccacagaactcaccatcaaaaaccatggacacattgagaaggatgagtcatgggttccagtatgtgattaattgcttctcctatagttgttcttgattcaattacattttatttatttggtaggtccaagaaaaatggg

SEQ ID NO: 3221 - DNA, 774 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacatgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggaatctttatgcttcctgaggctgttcttgaacatggctcttttttatgtgcattatc

SEQ ID NO: 3222 - DNA, 789 bp, Artificial
  Glycine max FAD3B mutation created with TALEN pair GmFAD3_T02.1
  misc_feature (296): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtggggacactgcattgccattccattcattgttgcgcataccatggatggttagttcatactggcttttttgtttgttcatttgtcattgaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaatgggaatctttatgcttcctgaggctgttcttgaacatggctcttttttatgtgcattatcttagttaa

SEQ ID NO: 3223 - DNA, 683 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacattcctcaattcttgtgccataccatggatggttagttcatactggcttttttgtttgttcatttgtcattgaaaaaaaaatcttttgttgattcaattatttttatagtgtgtttggaagcccgtttgagaaaaataagaaaatcgcatctggaatgtgaaaagttataactatttagcttcatttgtcgttgcaagttcttttattggttaaatttttatagcgtgctaggaaaacccattcgagaaaaataagaaatcacatctggaatgtgaaagttataactgttagcttctgagtaaacgtggaaaaaaccacattttggatttggaaccaaaattttatttgataaatgacaaccaaattgattttgatggatttgcaggatgaattagccacagaactcaccatcaaaaccatggacacattgagaaggatgagtcaatgggttccagtatgtgattaattgcttctcctatagttgttcttgattc

SEQ ID NO: 3224 - DNA, 776 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacctcaattcttgtgccataccatggatggttagttcatactggcttttttgtttgttcatttgtcattgaaaaaaaatcttttgttgattcaattatttttatagtgtgtttggaagcccgtttgagaaaaattaagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggaatctttatgcttcctgaggctgttcttgaacatggctcttttttatgtgcattatcttagttaa

SEQ ID NO: 3225 - DNA, 705 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacagcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggt

SEQ ID NO: 3226 - DNA, 751 bp, Artificial
  Glycine max FAD3B mutation created with TALEN pair GmFAD3_T02.1
  misc_feature (296): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacactgcattgccttccattcattgttgcgcataccatggatggttagttcatactggcttttttgtttgttcatttgtcattgaaaaaaaagtcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaaatgggaatctttatgcttcctgaggctgttc

SEQ ID NO: 3227 - DNA, 764 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacagcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaaatgggaatctttatgcttcctgaggctgttcttgaacatggctctttttt

SEQ ID NO: 3228 - DNA, 790 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggactcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtcccaagaaaaaaagggtaatctttatgcattcctgaggctgttcttgaacatggctcttttttatgtgtcatttatcttagttaa

SEQ ID NO: 3229 - DNA, 685 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattatttcattcctcaattcttgtgccataccatggatggttagttcatactggcttttttgtttgttcatttgtcattgaaaaaaagtcttttgttgattcaattatttttatagtgtgtttggaagcccgtttgagaaaataagaaatcgcatctggaatgtgaaagttataactatttagcttcatttgtcgttgcaagttcttttattggttaaatttttatagcgtgctaggaaaacccattcgagaaaataagaatcacatctggaatgtgaaagttataactgttagcttctgagtaaacgtggaaaaaaccacattttggatttggaaccaaattttatttgataaatgacaaccaaattgattttggatggattttgcaggagaattagccacagaactcaccatcaaaaaccatggacacattgagaaggatgagtcatgggttccagtatgtgattaattgcttctcctatagttgttcttgattcaattacattttatttatttggtaggtccaagaaaaaaggggaatctttatgcttcctgaggctgttcttg

SEQ ID NO: 3230 - DNA, 716 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattatttcattcctcaattcttgtgccataccatggatggttagttcatactggcttttttgtttgttcatttgtcattgaaaaaaatcttttgttgattcaattatttttatagtgtgtttggaagcccgtttgagaaaataagaaatcgcatctggaatgtgaaagttataactatttagcttcatttgtcgttgcaagttcttttattggttaaatttttatagcgtgctaggaaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaaaaggggaatctttatgcttcctgaggctgttcttgaacatggctcttttttatgtgtcattatcttag

SEQ ID NO: 3231 - DNA, 770 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacatttttatttatttggtagggtcccaagaaaaaaagggtaatctttatgcattcctgaggctgttcttgaacatggctctttttt

SEQ ID NO: 3232 - DNA, 679 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcctcaattcttgtgccataccatggatggttagttcatactggcttttttgtttgttcatttgtcattgaaaaaaagtcttttgttgattcaattatttttatagtgtgtttggaagcccgtttgagaaaataagaaatcgcatctggaatgtgaaagttataactatttagcttcatttgtcgttgcaagttcttttattggttaaatttttatagcgtgctaggaaaacccattcgagaaaataagaaatcacatctggaatgtgaaagttataactgttagcttctgagtaaacgtggaaaaaaccacattttggattttggaaccaaattttatttgataaatgacaaccaaaattgattttgatggattttgcaggagaattagccaaaagaactcaccatcaaaaaccatggacacattgagaaggatgagtcatgggttccagtatgtgattaattgcttctcctatagttgttcttgattcaattacattttatttatttggtaggtccaagaaaaaaaggggtaatctttatgcttcctgaggctgttcttgaaca

SEQ ID NO: 3233 - DNA, 789 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacagtgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaaatcgcatctggaatgtgaaaagttataactatttagcttcatttgtcgttgcaagttcttttattggttaaaatttttatagcgtgctaggaaacccattcgagaaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaaccatggacacattgagaaggatgagtcatgggttccagtatgtgattaattgcttctcctatagttgttcttgattcaattacattttatttatttggtaggtccaagaaaaaagggaatctttatgcttcctgaggctgttcttgaacatggctcttttttatgtgtcattatcttagttaa

SEQ ID NO: 3234 - DNA, 775 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacagcattcctcaattcttgtgccataccatggatggttagttcatactggcttttttgtttgttcatttgtcattgaaaaaaaagtcttttgttgattcaattatttttatagtgtgtttggaagcccgtttgagaaaaataagaaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtcccaagaaaaaaatgggaatctttatgcttcctgaggctgttcttgaacatggctcttttttatgtg

SEQ ID NO: 3235 - DNA, 753 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctttcctcaattcttgtgccataccatggatggttagttcatactggcttttttgtttgttcatttgtcattgaaaaaaactcttttgttgattcaattatttttatagtgtgtttggaagcccgtttgagaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtcccaagaaaaaaatgggtaatctttatgcttcctgaggctgttcttgaacatggctctttttt

SEQ ID NO: 3236 - DNA, 731 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacactgcattcctcaattcttgtgccataccatggatggttagttcatactggcttttttgtttgttcatttgtcattgaaaaaaaagtcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaagccatggacacattgagaaggatgagtcatgggttccagtatgtgattaattgcttctcctatagttgttcttgattcaattacattttatttatttggtaggtccaagaaaaaatgggaatcttttat

SEQ ID NO: 3237 - DNA, 704 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcctcaattcttgtgccataccatggatggttagttcatactggcttttttgtttgttcatttgtcattgaaaaaaatcttttgttgattcaattatttttatagtgtgtttggaagcccgtttgagaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaacttcaccatcaaaaaccatggacacattgagaaggatgagtcatgggttccagtatgtgattaattgcttctcctatagttgttcttgattcaattacattttatttatttggtaggtccaagaaaaaaggggaatctttatgcttcctgaggctgttcttgaacatggctcttttttcatgtgtcattatcttagtt

SEQ ID NO: 3238 - DNA, 788 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtggggacagcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtcccaagaaaaaagggtaatctttatgcattcctgaggctgttcttgaacatggctcttttttatgtgtcatttatcttagttaa

SEQ ID NO: 3239 - DNA, 504 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacagcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccaca

SEQ ID NO: 3240 - DNA, 758 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggactcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttatttgataaatgacaaccaaattgattttgatggattttgcaggagaattagccacagaactcaccatcaaaaccatggacacattgagaaaggatgagtcatgggttccagtatgtgattaattgcttctcctatagttgttcttgattcaattacattttatttatttggtaggtccaagaaaaagggtaatctttatgcattcctgaggtctgttcttgaacatggctctttttt

SEQ ID NO: 3241 - DNA, 607 bp, Artificial
  Glycine max FAD3B mutation created with TALEN pair GmFAD3_T02.1
  misc_feature (293): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggagcatcctcaattcttgtgtccataatcctatggcatgctagttcgatgtgtctggcttttttgtttgttcatttgtcattgaaaaaaaatcttttgttgattcaattntttttatagtgtgtttggaagcccgtttgagaaaaattaagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaatgattttgattggattttgcaggatgaattagccacagaactcaccatcaaaa

SEQ ID NO: 3242 - DNA, 717 bp, Artificial
  Glycine max FAD3B mutation created with TALEN pair GmFAD3_T02.1
ctcacacattgttctgttatgtcatttcttcttcatttggctttagacaacttaaatttgagatctttattatgttttttgcttatatggtaaagtgattcttcattatttcattcttcattgattgaattgaacagtggccatggaagcttttcagatagccctttgctgaatagcctggtggggacagcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaaggg

SEQ ID NO: 3243 - DNA, 790 bp, Artificial
  Glycine max FAD3B mutation created with TALEN pair GmFAD3_T02.1
  misc_feature (297): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatctttttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggaatctttatgcttcctgaggctgttcttgaacatggctcttttttatgtgtcattatcttagttaa

SEQ ID NO: 3244 - DNA, 711 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaaa

SEQ ID NO: 3245 - DNA, 705 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacaatctttttgttgattcaattatttttatagtgtgtttggaagcccgtttgagaaaataagaaatcgcatctggaatgtgaaagttataactatttagcttcatttgtcgttgcaagttcttttattggttaaatttttatagcgtgctaggaaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaaccatggacacattgagaaggatgagtcatgggttccagtatgtgattaattgcttctcctatagttgttcttgattcaattacattttatttatttggtaggtccaagaaaaaaaggggaatctttatgcttcctgaggctgttcttgaacatggctcttttttatgtgtcattatcttagtt

SEQ ID NO: 3246 - DNA, 790 bp, Artificial
  Glycine max FAD3B mutation created with TALEN pair GmFAD3_T02.1
ctcacacattgttctgttatgtcatttcttcttcatttggctttagacaacttaaatttgagatctttattatgttttttgcttatatggtaaagtgattcttcattatttcattcttcattgattgaattgaacagtggccatggaagcttttcagatagccctttgctgaatagcctggtgggacagcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtcccaagaaaaaaagggtaatcttttatgcattcctgaggctgttcttgaacatggctcttttttatgtgcatttatcttagttaa

SEQ ID NO: 3247 - DNA, 754 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagcccttttcagatagcattcctcaattcttgtgccataccatggatggttagttcatactggcttttttgtttgttcatttgtcattgaaaaaaatcttttgttgattcaattatttttatagtgtgtttggaagcccgtttgagaaaataagaaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggaatctttatgcattcctgaggctgttcttgaacatggctcttttttatgtgtca

SEQ ID NO: 3248 - DNA, 783 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacactgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaatgggaatctttatgcttcctgaggctgttcttgaacatggctcttttttatgtgcattatcttagttaa

SEQ ID NO: 3249 - DNA, 726 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacactgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtcccaaagaaaaaaaatggggt

SEQ ID NO: 3250 - DNA, 774 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacaattcctcaattcttgtgccataccatggatggttagttcatactggcttttttgtttgttcatttgtcattgaaaaaaaatcttttgttgattcaattatttttatagtgtgtttggaagcccgttttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaatgaaaaaagggaaagtcttttaatgcattcctgaggtctgtttcttgaacatggctcttttttta

SEQ ID NO: 3251 - DNA, 783 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaaagggtaatctttatgcattcctgaggctgttcttgaacatggctcttttttatgtgtcatttatcttagttaa

SEQ ID NO: 3252 - DNA, 740 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacactgcattcctcaattcttgtgccataccatggatggttagttcatactggcttttttgtttgttcatttgtcattgaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttgggtaggtccaagaaaaagggtaatctttatgcattcctgagg

SEQ ID NO: 3253 - DNA, 767 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtggggacattcattcctcaattcttgtgccataccatgggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaaacccattcgagaaaataagaaatcacatctggaatgtgaaagttataactgttagcttctgagtaaacgtggaaaaaccacattttggatttggaaccaaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggaatctttatgcattcctgaggtctgttcttgaacatggctctttttt

SEQ ID NO: 3254 - DNA, 734 bp, Artificial
  Glycine max FAD3B mutation created with TALEN pair GmFAD3_T02.1
  misc_feature (683): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacagcaataatggtggcaagcaggcgctggagacggtccagcggctgttgccggtgctgtgccaggcccacggcttgaccccccagcaggtggtggcaggcgctggagacgcattcctcaattcttgtgccataccatggatggttagttcatactggctttttgtttgttcatttgtcattgaaaaaatcttttgttgattcaattatttttatagtgtgtttggaagcccgtttgagaaaataagaaatcgcatctggaatgtgaaagttataactatttagcttcatttgtcgttgcaaagttcttttattggttaaaatttttatagcgtgctaggaaacccattcgagaaaataagaaatcacatctggaatgtgaaagttataactgttagcttctgagtaaacgtggaaaaaccacattttggatttggaaccaaaatttttatttgataaatgatcaaccaaattgattttgatggaattttgtcaggngaattagccaacagaactcaccatcaaaaccatggacacaattgagaagga

SEQ ID NO: 3255 - DNA, 782 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggactcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaaattagccacatgaactcaccatcaaaaccatggacacattgagaaggatgagtcatgggttccagtatgtgattaattgcttctcctatagttgttcttgattcaattacattttatttatttggtagggtccaagaaaaagggtaatctttatgcattcctgaggctgttcttgaacatggctctttttaatgtgtcatttat

SEQ ID NO: 3256 - DNA, 754 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagcccttttcagatagcattcctcaattcttgtgccataccatggatggttagttcatactggcttttttgtttgttcatttgtcattgaaaaaaatctttttgttgattcaattatttttatagtgtgtttggaagcccgtttgagaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggaatctttatgcattcctgaggctgttcttgaacatggctcttttttatgtgtca

SEQ ID NO: 3257 - DNA, 677 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacagcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgatt

SEQ ID NO: 3258 - DNA, 836 bp, Artificial
  Glycine max FAD3B mutation created with TALEN pair GmFAD3_T02.1
  misc_feature (597): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatgttgccggtgctgtgccaggcccacggcttgaccccggagcaggtggtggccatcgccagcaatattcctcaattcttgtgccataccatggatggttagttcatactggcttttttgtttgttcatttgtcattgaaaaaaatcttttgttgattcaattattttatagtgtgtttggaagcccgtttgagaaaataagaaatcgcatctggaatgtgaaagttataactatttagcttcatttgtcgttgcaagttcttttattggttaaatttttatagcgtgctaggaaacccattcgagaaaaattaagaatacatctggatgtgaaagttataactgttagcttctgagtaaacgtggaaaaaccacatttggatttggaccaaatttattgataaaatgncaaccaaattgatttgatggattttgcaggagaattagccacagaatctcaccatcaaaatccatggacacattgagaaggatgagtcatgggttccagtatgtgattaattgcttctcctatagttgttcttgattcaattacattttatttatttggtaggtccaagaaaaagggaatctttatgcttcctgaggctgttcttgaacatggctcttttttatgtgtcattatcttag

SEQ ID NO: 3259 - DNA, 698 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttgg

SEQ ID NO: 3260 - DNA, 763 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggaatctttatgcattcctgaggctgttcttgaacatggctcttttttatgtgtca

SEQ ID NO: 3261 - DNA, 447 bp, Artificial
  Glycine max FAD3B mutation created with TALEN pair GmFAD3_T02.1
ctcacacattgttctgttatgtcatttcttcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaaggatgagtcatgggttccagtatgtgattaattgcttctcctatagttgttcttgattcaattacattttatttatttggtaggtccaagaaaaaagggaatctttatgcttcctgaggctgttcttgaacatggctctttttatgtgtcattatcttagttaa

SEQ ID NO: 3262 - DNA, 780 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacagcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaagggatgagtcatgggttccagtatgtgattaattgcttctcctatagttgttcttgattcaattacattttatttatttggtagggtccaagaaaaagggtaatctttatgcattcctgaggctgttcttgaacatggctcttttttatgtgcatttatcttag

SEQ ID NO: 3263 - DNA, 506 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtggggacacagcattcctcaattcttgtgccataccatggatggttagttcatactggcttttttgtttgttcatttgtcattgaaaaaaaagtcttttgttgattcaattatttttatagtgtgtttggaagcccgtttgagaaaaattaagaaatcgcatctggaatgtgaaaagttataactatttagcttcatttgtcgttgcaagttcttttattggttaaatttttcatagcgtgctaggaaacccattcgagaaaagtaagaaatcacatctggaatgtgaaagttataactgttagcttctgagtaaacgtggaaaaa

SEQ ID NO: 3264 - DNA, 773 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacactgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaaatgggaatcttttatgcttcctgaggctgttcttgaacatggctcttttttatgtgca

SEQ ID NO: 3265 - DNA, 721 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacagcattcctcaattcttgtgccataccatggatggttagttcatactggcttttttgtttgttcatttgtcattgaaaaaaaagtcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaagccatggacacattgagaaggatgagtcatgggttccagtatgtgattaattgcttctcctatagttgttcttgattcaattacattttatttatttggtaggtccaagaaaaatggg

SEQ ID NO: 3266 - DNA, 786 bp, Artificial
  Glycine max FAD3B mutation created with TALEN pair GmFAD3_T02.1
  misc_feature (293): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacactgcattgcctccatcattgttgcgcataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggaatctttatgcttcctgaggctgttcttgaacatggctcttttttatgtgtcattatcttagttaa

SEQ ID NO: 3267 - DNA, 661 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgcattcctcaattcttgtgccataccatggatggttagttcatactggcttttttgtttgttcatttgtcattgaaaaaaactcttttgttgattcaattatttttatagtgtgtttggaaagcccgttttgagaaaattaagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaatccacattttggatttggaaccaaaattttgatttgataaatgacaaccaaattgattttgatggattttgcaggagaattagccacagaactcaccatcaaaagccatggacacattgagaaggatgagtcatgggttccagtatgtgattaattgcttctcctatagttgttcttgatt

SEQ ID NO: 3268 - DNA, 702 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcctcaattcttgtgccataccatggatggttagttcatactggcttttttgtttgttcatttgtcattgaaaaaaatcttttgttgattcaattatttttatagtgtgtttggaagcccgtttgagaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaaaagggaatctttatgcttcctgaggctgttcttgaacatggctcttttttatgtgtcattatcttagtt

SEQ ID NO: 3269 - DNA, 769 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaatgggaatctttagcttcctgaggctgttcttgaacatggctcttttttatgtgcattatc

SEQ ID NO: 3270 - DNA, 782 bp, Artificial
  Glycine max FAD3B mutation created with TALEN pair GmFAD3_T02.1
  misc_feature (289): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttcctcattcattgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggaatctttatgcttcctgaggctgttcttgaacatggctcttttttatgtgtcattatcttagttaa

SEQ ID NO: 3271 - DNA, 770 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacagcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtcccaaagaaaaaaagggtaatctttatgcattcctgaggtctgttcttgaacatggctctttttt

SEQ ID NO: 3272 - DNA, 696 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgtgatgcattcctcaattcttgtgccataccatggatggttagttcatactggcttttttgtttgttcatttgtcattgaaaaaaaagtcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttattt

SEQ ID NO: 3273 - DNA, 758 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacatcctcaattcttgtgccataccatggatggttagttcatactggcttttttgtttgttcatttgtcattgaaaaaaaagtcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaatgggaatctttatgcttcctgaggctgttcttgaacatggctctttttt

SEQ ID NO: 3274 - DNA, 528 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacagcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagtttctgagtaaacgtggaaaaaccacattttggatttggaaccaaatttt

SEQ ID NO: 3275 - DNA, 773 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtggggacagcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttatttgataaatgacaaccaaattgattttgatggattttgcaggagaattagccacagaactcaccatcaaaaaccatggacacattgagaaggatgagtcatgggttccagtatgtgattaattgcttctcctatagttgttcttgattcaattacattttatttatttggtaggtccaagaaaaagggtaatctttatgcattcctgaggctgttcttgaacatggctcttttttatgtgtca

SEQ ID NO: 3276 - DNA, 700 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggt

SEQ ID NO: 3277 - DNA, 790 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtcccaagaaaaaagggtaatctttatgcattcctgaggctgttcttgaacatggctcttttttatgtgtcatttatcttagttaa

SEQ ID NO: 3278 - DNA, 778 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtcccaagaaaaaaatgggtaatcttttatgcttcctgaggctgtttcttgaacatggctcttttttatgtgca

SEQ ID NO: 3279 - DNA, 772 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagccttcctcaattcttgtgccataccatggatggttagttcatactggcttttttgtttgttcatttgtcattgaaaaaaactctttttgttgattcaattatttttatagtgtgtttggaagcccgtttgagaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggtaatctttatgcattcctgaggctgttcttgaacatggctcttttttatgtgtcattatcttagttaa

SEQ ID NO: 3280 - DNA, 783 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaaagggaatctttatgcattcctgaggtctgttcttgaacatggctcttttttatgtgtcattatcttagttaa

SEQ ID NO: 3281 - DNA, 514 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacactcctcaattcttgtgccataccatggatggttagttcatactggcttttttgtttgttcatttgtcattgaaaaaaaatcttttgttgattcaattattttttattagtgtgttttggaagcccgtttgagaaaaataagaaaatcgcatctggaatgtgaaagttataactatttagctcatttgtcgttgctaagtcttttaattggtttaaaatttttatagcggtgctaggaaaacccattcgagaaaataagaaatcacatctggaatgtgaaagttataactgttagcttctgagtaaacgtggaaaaaccacattttgg

SEQ ID NO: 3282 - DNA, 706 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcctcaattcttgtgccataccatggatggttagttcatactggcttttttgtttgttcatttgtcattgaaaaaaatcttttgttgattcaattatttttatagtgtgtttggaagcccgtttgagaaaataagaaatcgcatctggaatgtgaaagttataactatttagcttcatttgtcgttgcaagttcttttattggttaaatttttatagcgtgctaggaaacccattcgagaaaattaagaatcacatctggaatgtgaaagttataactgttagcttctgagtaaacgtggaaaaaccacattttggatttggaaccaaattttatttgataaatgacaaccaaattgattttgatggattttgcaggagaattagccacagaacttcaccatcaaaaatccatggacacattgagaaggatgagtcatgggttccagtatgtgattaatttgcttctcctatagttgttcttgattcaattacattttatttatttggtaggtccaagaaaaaaaggggaatctttatgcttcctgaggctgttcttgaacatggctcttttttatgtgtcattatcttagtt

SEQ ID NO: 3283 - DNA, 716 bp, Artificial
  Glycine max FAD3B mutation created with TALEN pair GmFAD3_T02.1
ctcacacattgttctgttatgtcatttcttcttcatttggctttagacaacttaaatttgagatctttattatgttttttgcttatatggtaaagtgattcttcattatttcattcttcattgattgaattgaacagtggccatggaagcttttcagatagccctttgctgaatagcctggtggggacacattcctcaattcttgtgccataccatggatggttagttcatactggcttttttgtttgttcatttgtcattgaaaaaaaagtcttttgttgattcaattatttttatagtgtgtttggaagcccgtttgagaaaaattaagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaatccacattttggatttggaaccaaattttgattttgataaatgacaaccaaattgattttgatggattttgcaggagaattagccacagaactcaccatcaaaagccatggacacattgagaaggatgagtcatgggtttccagtatgtgattaattgcttctcctatagttgttcttgattccaattacatttttattttattttgggtagggt

SEQ ID NO: 3284 - DNA, 770 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggaagcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaagggtaatctttatgcattcctgaggctgttcttgaacatggctcttttttatgtgtca

SEQ ID NO: 3285 - DNA, 784 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttatttgataaatgacaaccaaattgattttgatggattttgcaggagaattagccacagaactcaccatcaaaaccatggacacattgagaaaggatgagtcatgggttccagtatgtgattaattgcttctcctatagttgttcttgattcaattacattttatttatttggtagggtccaagaaaaaagggtaatcttttatgcattcctgaggtctgttcttgaacatggctcttttttatgtgtcattatcttagttaa

SEQ ID NO: 3286 - DNA, 685 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgttgaatagcctggtgggacacagcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattaca

SEQ ID NO: 3287 - DNA, 748 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagccttcctcaattcttgtgccataccatggatggttagttcatactggcttttttgtttgttcatttgtcattgaaaaaaactcttttgttgattcaattatttttatagtgtgtttggaagcccgtttgagaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaagggaatctttagcttcctgaggctgttcttgaacatggctcttttttat

SEQ ID NO: 3288 - DNA, 762 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggatctttatgcattcctgaggctgttcttgaacatggctctttttt

SEQ ID NO: 3289 - DNA, 781 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtcccaagaaaaagggtaatctttatgcattcctgaggtctgttcttgaacatggctcttttttatgtgtcattatcttagttaa

SEQ ID NO: 3290 - DNA, 699 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcctcaattcttgtgccataccatggatggttagttcatactggcttttttgtttgttcatttgtcattgaaaaaaatcttttgttgattcaattatttttatagtgtgtttggaagcccgtttgagaaaataagaaatcgcatctggaatgtgaaagttataactatttagcttcatttgtcgttgcaagttcttttattggttaaatttttatagcgtgctaggaaaacccattcgagaaaataagaaatcacatctggaatgtgaaagttataactgttagcttctgagtaaacgtggaaaaaaccacattttggatttggaaccaaattttatttgataaatgacaaccaaattgattttgatggattttgcaggagaattagccaaagaactcaccatcaaaaaccatggacacattgagaaggatgagtcatgggttccagtatgtgattaattgcttctcctatagttgttcttgattcaattacattttatttatttggtaggtccaagaaaaaaaggggaatctttatgcttcctgaggctgttcttgaacatggctcttttttatgtgtcattatc

SEQ ID NO: 3291 - DNA, 768 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacagcattcctcaattcttgtgccataccatggatggttagttcatactggcttttttgtttgttcatttgtcattgaaaaaaaagtcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaaaatgggaatctttatgcttcctgaggctgttcttgaacatggctctttttt

SEQ ID NO: 3292 - DNA, 786 bp, Artificial
  Glycine max FAD3B mutation created with TALEN pair GmFAD3_T02.1
  misc_feature (293): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacactgcttgcctccattcattgttgcgcataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggaatctttatgcttcctgaggctgttcttgaacatggctcttttttatgtgtcattatcttagttaa

SEQ ID NO: 3293 - DNA, 766 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggactacaacgtcgtgactgggaaaaccctggcgttacccaacttaatcgccttgcagcacatccccctttcgccagctggcgtaatagcgaagaggcccgcaccgatcgcccttgcattcctcaattcttgtgccataccatggatggttagttcatactggcttttttgtttgttcatttgtcattgaaaaaaaatcttttgttgattcaattatttttatagtgtgtttggaagcccgtttgagaaaataagaaatcgcatctggaatgtgaaagttataactatttagcttcatttgtcgttgcaagttcttttattggttaaattttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaaattgattttgatggatttttgcaggagaattagccacagaactcaccatcaaaaccatggacacattgagaaggatgagtcatgggttccagtatgtgattaattgcttct

SEQ ID NO: 3294 - DNA, 729 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacaattcttgtgccataccatggatggttagttcatactggcttttttgtttgttcatttgtcattgaaaaaaactcttttgttgattcaattatttttatagtgtgtttggaagcccgtttgagaaaataagaaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggaatctttatgcttcctgaggctg

SEQ ID NO: 3295 - DNA, 773 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacagcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaaagggtaatctttatgcattcctgaggctgttcttgaacatggctctttttatgtgtca

SEQ ID NO: 3296 - DNA, 764 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttgtatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaaagggtaatctttatgcattcctgaggctgttcttgaacatggctcttttt

SEQ ID NO: 3297 - DNA, 776 bp, Artificial
  Glycine max FAD3B mutation created with TALEN pair GmFAD3_T02.1
ctcacacattgttctgttatgtcatttcttcttcatttggctttagacaacttaaatttgagatctttattatgttttttgcttatatggtaaagtgattcttcattatttcattcttcattgattgaattgaacagtggccatggaagcttttcagatagccctttgctgaatagcctggtggggacgcattcctcaattcttgtgccataccatggatggttagttcatactggcttttttgtttgttcatttgtcattgaaaaaaaagtcattttgttgattcaattatttttattagtgtgtttggaatgcccgctttgagaaaaataagaaatcgcatctggaatgtgaaaagttataactatttagcttcatttgtcgttgcaagttcttttattggttaaatttttatagcgtgctaggaaacccattcgagaaaagtaagaaattcacatctggaatgtgaaagttataactgttagcttctgagtaaacgtggaaaaatccacattttggatttggaaccaaaattttgatttgataaatgacaaccaaagttgattttgatggattttgcaggagaattagccacagaactcaccatcaaaagccatggacacattgagaaggatgagtcatgggttccagtatgtgattaattgcttctcctatagttgttcttgattcaattacattttatttatttggtaggtccaagaaaaaatgggaatctttatgcttcctgaggctgttcttgaacatggctctttttt

SEQ ID NO: 3298 - DNA, 702 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacagcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggta

SEQ ID NO: 3299 - DNA, 711 bp, Artificial
  Glycine max FAD3B mutation created with TALEN pair GmFAD3_T02.1
  misc_feature (299): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacagtcatttgccattccattcattgcttgcgcataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggatgaattagccacagaactcaccatcaaaaccatggacacattgagaaggatgagtcatgggttccagtatgtgattaattgcttctcctatagttgttcttgattcaattacattttatttatttggta

SEQ ID NO: 3300 - DNA, 717 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattatttcattcctcaattcttgtgccataccatggatggttagttcatactggcttttttgtttgttcatttgtcattgaaaaaaatcttttgttgattcaattatttttatagtgtgtttggaagcccgtttgagaaaataagaaatcgcatctggaatgtgaaagttataactatttagcttcatttgtcgttgcaagttcttttattggttaaatttttatagcgtgctaggaaaacccattcgagaaaataagaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaaccatggacacattgagaaggatgagtcatgggttccagtatgtgattaattgcttctcctatagttgttcttgattcaattacattttatttatttggtaggtccaagaaaaaaggggaatctttatgcttcctgaggctgttcttgaacatggctcttttttatgtgtcattatcttagtt

SEQ ID NO: 3301 - DNA, 881 bp, Artificial
  Glycine max FAD3B mutation created with TALEN pair GmFAD3_T02.1
  misc_feature (845): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacacaacagcgcctgcaccgtctccagcgcctgcttgccaccaatattgctggcgatggccaccacctgctccggggtcaagccgtgggcctggcacagcaccggcaagcattcctcaattcttgtgccataccatggatggttagttcatactggctttttgtttgttcatttgtcattgaaaaaaatcttttgttgattcaattatttttatagtgtgttttggaagcccgtttgagaaaataagaaatcgcatctggaatgtgaaagttataactatttagcttcatttgtcgttgcaagttctttattggttaaatttttatagcgtgctaggaaacccattcgagaaaataagaaatcacatctggaatgtgaaagttataactgttagcttctgagtaaacgtggaaaaaccacattttggatttggaaccaaaattttatttgataaatgacaaccaaattgatttttgatggatttttgcaggagaatttagccacagaactcaccatcaaaaccatggacacattgagaaggatgagtcatgggttcccaagtatgtgatttaattgcttctcctatagttggttcttgattcaattacattttatttatttggtaggtccaagaaaaagggaatctttatgcttcctgnggctgttcttgaacaatggctcttttttatgtgtca

SEQ ID NO: 3302 - DNA, 779 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacagcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaaccatggacacattgagaaggatgagtcatgggttccagtatgtgattaattgcttctcctatagttgttcttgattcaattacattttatttatttggtagggtccaagaaaaaatgggaatctttatgcttcctgaggctgttcttgaacaggctcttttttatgtgtcattatc

SEQ ID NO: 3303 - DNA, 772 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtggtttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaaaagggtaatctttatgcattcctgaggtctgttcttgaacatggctcttttttatgtg

SEQ ID NO: 3304 - DNA, 518 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggactcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaccacatttggatttggaa

SEQ ID NO: 3305 - DNA, 841 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacaacggtccagcggctgttgccggtgctgtgccaggcccacggcttgaccccccagcaggtggcattcctcaattcttgtgccataccatggatggttagttcatactggctttttgtttgttcatttgtcattgaaaaaaatcttttgttgattcaattatttttatagtgtgtttggaagcccgtttgagaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttgggatttgggaaccaaaatttatttgataaatgacaaccaaattgatttgatggattttgcaggagaattagccacagaatctcaccatcaaaatccatggacacattgagaaggatgagtcatgggttccagtatgtgattaattgcttctcctatagttgttcttgattcaattacattttatttatttggtaggtccaagaaaaagggaatctttatgcttcctgaggctgtttcttgaacatggctcttttttagtcattatcttagttaa

SEQ ID NO: 3306 - DNA, 767 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagccttcctcaattcttgtgccataccatggatggttagttcatactggcttttttgtttgttcatttgtcattgaaaaaaatcttttgttgattcaattatttttatagtgtgtttggaagcccgtttgagaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtgaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaaagggaatctttatgcttcctgaggctgttcttgaacatggctcttttttatgtgtcattatcttagttaa

SEQ ID NO: 3307 - DNA, 702 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggagcattcctcaattcttgtgccataccatggatggttagttcatactggcttttttgtttgttcatttgtcattgaaaaaaaagtcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggg

SEQ ID NO: 3308 - DNA, 687 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacttgcattcctcaattcttgtgccataccatggatggttagttcatactggcttttttgtttgttcatttgtcattgaaaaaaaagtcttttgttgattcaattatttttatagtgtgtttggaagcccgtttgagaaaaattaagaaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaatccacattttggatttggaaccaaaattttatttgataaatgacaaccaaattgattttgatggattttgcaggagaattagccacagaactcaccatcaaaaaccatggacacattgagaaggatgagtcatgggttccagtatgtgattaattgcttctcctatagttgttcttgattc

SEQ ID NO: 3309 - DNA, 783 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacactgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaaggtaatctttatgcttcctgaggctgttctttgaacatggctcttttttatgtgcattatcttagttaa

SEQ ID NO: 3310 - DNA, 779 bp, Artificial
  Glycine max FAD3B mutation created with TALEN pair GmFAD3_T02.1
  misc_feature (296): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtggggacactgcattgccttccattcattgttgcgcataccatggatggttagttcatactggcttttttgtttgttcatttgtcattgaaaaaaaatcttttgttgattcaattntttttatagtgtgtttggaagcccgtttgagaaaaattaagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggaatctttatgcttcctgaggctgttcttgaacatggctcttttttatgtgcatta

SEQ ID NO: 3311 - DNA, 686 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacagcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattaca

SEQ ID NO: 3312 - DNA, 777 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtcccaagaaaaaagggtaatctttatgcattcctgaggtctgttcttgaacatggctcttttttatgtgtca

SEQ ID NO: 3313 - DNA, 499 bp, Artificial
  Glycine max FAD3B mutation created with TALEN pair GmFAD3_T02.1
  misc_feature (298): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatctttttgcattcctcaattcttgtgccataccatggatggttagttcatactggcttttttgtttgttcatttgtcattgaaaaaaaagtcttttgttgattcaattntttttatagtgtgtttggaagcccgtttgagaaaaattaagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaa

SEQ ID NO: 3314 - DNA, 769 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtggggacagcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggttcccaagaaaaaagggtaatctttatgcattcctgaggtctgttcttgaacatggctctttttt

SEQ ID NO: 3315 - DNA, 782 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacactgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaaacccattcgagaaaaataagaaatcacatctggaatgtgaaagttataactgttagcttctgagtaaacgtggaaaaaaccacattttggatttggaaccaaaattttatttgataaatgacaaccaaattgattttgatggattttgcaggagaattagccacagaactcaccatcaaaaaccatggacacattgagaaaggatgagtcatgggttccagtatgtgattaattgcttctcctatagttgttcttgattcaaattacattttatttatttggtaggtccaagaaaaagggaatctttatgcattcctgaggctgttcttgaacatggctcttttttatgtgtcattt

SEQ ID NO: 3316 - DNA, 768 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggattgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaaattagccacagaactcaccatcaaaaccatggacacattgagaaggatgagtcatgggttccagtatgtgattaattgcttctcctatagttgttcttgattcaattacattttatttatttggtagggtccaagaaaaaagggtaatctttatgcattcctgaggtctgttcttgaacatggctctttttta

SEQ ID NO: 3317 - DNA, 783 bp, Artificial
  Glycine max FAD3B mutation created with TALEN pair GmFAD3_T02.1
  misc_feature (747): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttcttgcattcctcaattcttgtgccataccatggatggttagttcatactggcttttttgtttgttcatttgtcattgaaaaaaaatcttttgttgattcaattatttttatagtgtgtttggaagcccgtttgagaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaatctcaccatcaaaaccatggacacattggagaggatgagtcatggttccagtatgtgattaattgcttctcctatagttgttcttgattcaattacatttttatttattttgggtaggtccaagaaaaaaggggaatctttatgcttcctgngctgttccgaacatggctcttttttatgtgtcatta

SEQ ID NO: 3318 - DNA, 771 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacactgcattcctcaattcttgtgccataccatggatggttagttcatactggcttttttgtttgttcatttgtcattgaaaaaaaagtcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaaataagaaatcacatctggaatgtgaaagttataactgttagcttctgagtaaacgtggaaaaaccacattttggatttggaaccaaattttgattttgataaatgacaaccaaattgattttgatggattttgcaggagaattagccacagaactcaccatcaaaagccatggacacattgagaaggatgagtcatgggttccagtatgtgattaattgcttctcctatagttgttcttgattcaattacattttatttatttggtagggtccaagaaaaaatgggaatctttatgcttcctgaggctgttcttgaacatggctctttttt

SEQ ID NO: 3319 - DNA, 783 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaaacccattcgagaaaaataagaaatcacatctggaatgtgaaagttataactgttagcttctgagtaaacgtggaaaaaccacattttggatttggaaccaaaattttatttgataaatgacaaccaaattgattttgatggattttgcaggagaaattagccacagaactcaccatcaaaaccatggacacattgagaaggatgagtcatgggttccagtatgtgattaattgcttctcctatagttgttcttgattcaattacattttatttatttggtaggtccaagaaaaagggtaatctttatgcattcctgaggtctgttcttgaacatggctcttttttatgtgtcattatctagttaa

SEQ ID NO: 3320 - DNA, 775 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtcccaagaaaaaaatgggaatctttatgcttcctgaggctgttcttgaacatggctcttttttatgtgcattatctta

SEQ ID NO: 3321 - DNA, 789 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggataagtgattctttcattatttcattcttcattgattgaattgaacagctggccatggaagcttttcagatagccctttgctgaatagcctggtgggacacagcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaagggaatctttatgcattcctgaggtctgttcttgaacatggctcttttttatgtgtcatttatctagttaa

SEQ ID NO: 3322 - DNA, 766 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacagcattcctcaattcttgtgccataccatggatggttagttcatactggcttttttgtttgttcatttgtcattgaaaaaaaagtcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaagccatggacacattgagaaggatgagtcatgggttccagtatgtgattaattgcttctcctatagttgttcttgattcaattacattttatttatttggtagggtccaagaaaaatgggaatctttatgcttcctgaggctgttcttgaacatggctctttttt

SEQ ID NO: 3323 - DNA, 807 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcaacgcggccaacgccggatcagggcgagataactgggcaacaatgctctccagcgccggcctgccgccgccattgctggcgatggccaccacctgctgaggggtttgcattcctcaattcttgtgccataccatggatggttagttcatactggctttttgtttgttcatttgtcattgaaaaaaatcttttgttgattcaattatttttatagtgtgtttggaagcccgtttgagaaaaataagaaatcgcatctggaatgtgaaagttataactatttagcttcatttgtcgttgcaaagttcttttattggttaaaatttttatagcgtgctaggaaacccattcgagaaaataagaaatcacatctggaatgtgaaagttataactgttagcttctgagtaaacgtgggaaaaaaccacattttggatttggaaccaaaatttttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacatttttattta

SEQ ID NO: 3324 - DNA, 615 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagccttcctcaattcttgtgccataccatggatggtttagttcatactggcttttttgtttgttcatttgtcattgaaaaaaactcttttgttgattcaattattttatagtgtgttgaagccgtttgagaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacatgaactcaccatcaaaaccatggacacattgagaaggatgagtcatggg

SEQ ID NO: 3325 - DNA, 623 bp, Artificial
  Glycine max FAD3B mutation created with TALEN pair GmFAD3_T02.1
  misc_feature (606): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacaagttataactatttagcttcatttgtcgttgcaagttcttttattggttaaatttttatagcgtgctaggaaacccattcgagaaaataagaaatcacatctggaatgtgaaaagttataactgttagcttctgagtaaacgtggaaaaaccacattttggatttggaaccaaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttattttatttggtaggtccaagaaaaaagggaatctttatgcttcctgaggctgttcttgaacatggctcttttttangtgtcattatcttagtt

SEQ ID NO: 3326 - DNA, 790 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacagcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtcccaagaaaaaaagggtaatcttttaatggcttcctgaggtctgttcttgaacatggctcttttttatgtgtcatatctagttaa

SEQ ID NO: 3327 - DNA, 772 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacaattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaagggtaatctttatgcattcctgaggctgttcttgaacatggctcttttttatgtgtca

SEQ ID NO: 3328 - DNA, 681 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatgtcctcaattcttgtgccataccatggatggttagttcatactggcttttttgtttgttcatttgtcattgaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattaca

SEQ ID NO: 3329 - DNA, 776 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggactcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttgggtagggtcccaagaaaaagggtaatctttatgcattcctgaggctgttcttgaacatggctcttttttatgtgtca

SEQ ID NO: 3330 - DNA, 721 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggcattcctcaattcttgtgccataccatggatggttagttcatactggctttttttgtttgttcatttgtcattgaaaaaaaagtcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaatgggaatcttt

SEQ ID NO: 3331 - DNA, 785 bp, Artificial
  Glycine max FAD3B mutation created with TALEN pair GmFAD3_T02.1
  misc_feature (293): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacactgcattgcctccattcattgttgcgcataccatggatggttagttcatactggcttttttgtttgttcatttgtcattgaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggaatctttatgcttcctgaggctgttcttgaacatggctcttttttatgtgcattatcttagttaa

SEQ ID NO: 3332 - DNA, 778 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacactgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggaatctttatgcttcctgaggctgttcttgaacatggctcttttttatgtgcattatcttag

SEQ ID NO: 3333 - DNA, 789 bp, Artificial
  Glycine max FAD3B mutation created with TALEN pair GmFAD3_T02.1
  misc_feature (296): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacactgtcattgccttccattcattgttgcgcataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggaatctttatgcttcctgaggctgttcttgaacatggctcttttttatgtgtcattatcttagttaa

SEQ ID NO: 3334 - DNA, 786 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggagcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtcccaagaaaaaagggtaatcttttatgcattcctgaggtctgttcttgaacatggctcttttttatgtgtcattatcttagttaa

SEQ ID NO: 3335 - DNA, 766 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgcattcctcaattcttgtgccataccatggatggttagttcatactggcttttttgtttgttcatttgtcattgaaaaaaatcttttgttgattcaattatttttatagtgtgtttggaagcccgtttgagaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacatttttatttattttggtagggtcccaagaaaaaaagggaatctttatgcattcctgaggtctgttcttgaacatggctcttttttatgtgtcattatcttagttaa

SEQ ID NO: 3336 - DNA, 708 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtggggacattgcattcctcaattcttgtgccataccatggatggttagttcatactggcttttttgtttgttcatttgtcattgaaaaaaaagtcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggt

SEQ ID NO: 3337 - DNA, 786 bp, Artificial
  Glycine max FAD3B mutation created with TALEN pair GmFAD3_T02.1
ctcacacattgttctgttatgtcatttcttcttcatttggctttagacaacttaaatttgagatctttattatgttttttgcttatatggtaaagtgattcttcattatttcattcttcattgattgaattgaacagtggccatggaagcttttcagatagccctttgctgaatagcctggtgggacattgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggaatctttatgcattcctgaggctgttcttgaacatggctcttttttatgtgtcatttatcttagttaa

SEQ ID NO: 3338 - DNA, 703 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatgcattcctcaattcttgtgccataccatggatggttagttcatactggcttttttgtttgttcatttgtcattgaaaaaaagtcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggta

SEQ ID NO: 3339 - DNA, 769 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggaatctttatgcattcctgaggctgttcttgaacatggctcttttttatgtgtca

SEQ ID NO: 3340 - DNA, 776 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacagcattgccttcattcattgttgcgcataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaaagggaatctttatgcttcctgaggtctgttcttgaacatggctcttttttatgtgtca

SEQ ID NO: 3341 - DNA, 764 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggattgcattcctcaattcttgtgccataccatggatggttagttcatactggctttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaaatgggaatctttatgcttcctgaggctgttcttgaacatggctctttttt

SEQ ID NO: 3342 - DNA, 792 bp, Artificial
  Glycine max FAD3B mutation created with TALEN pair GmFAD3_T02.1
  misc_feature (297): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatttgtttgcattcctcaattcttgtgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggaatctttatgcattcctgaggctgttcttgaacatggctctttttaatgtgtcatttatctagttaa

SEQ ID NO: 3343 - DNA, 693 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacagcattcctcaattcttgtgccataccatggatggttagttcatactggcttttttgtttgttcatttgtcattgaaaaaaaagtcttttgttgattcaattatttttatagtgtgtttggaagcccgtttgagaaaaattaagaaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacatttta

SEQ ID NO: 3344 - DNA, 697 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggatgcattcctcaattcttgtgccataccatggatggttagttcatactggctttttttgtttgttcatttgtcattgaaaaaaaagtcttttgttgattcaattatttttatagtgtgtttggaagcccgtttgagaaaaataagaaatcgcatctggaatgtgaaaagttataactatttagcttcatttgtcgttgcaagttcttttattggttaaaatttttatagcgtgctaggaaacccattcgagaaaataagaaatcacatctggaatgtgaaagttataactgttagcttctgagtaaacgtggaaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacatttttattta

SEQ ID NO: 3345 - DNA, 706 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacagcattgccttccattcattgttgcgcataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggta

SEQ ID NO: 3346 - DNA, 763 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgcattcctcaattcttgtgccataccatggatggttagttcatactggcttttttgtttgttcatttgtcattgaaaaaaatcttttgttgattcaattatttttatagtgtgtttggaagcccgtttgagaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtcccaagaaaaaagggaatctttatgcattcctgaggtctgttcttgaacatggctcttttttatgtgtcattatcttagttaa

SEQ ID NO: 3347 - DNA, 773 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgttgaatagcctggtgggacacagcattcctcaattcttgtgccataccatggatggttagttcatactggcttttttgtttgttcatttgtcattgaaaaaaaatcttttgttgattcaattatttttatagtgtgtttggaagcccgtttgagaaaaattaagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaaatgggaatctttatgcttcctgaggctgttcttgaacatggctcttttttatgtgca

SEQ ID NO: 3348 - DNA, 674 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacgcattcctcaattcttgtgccataccatggatggttagttcatactggcttttttgtttgttcatttgtcattgaaaaaaaatcttttgttgattcaattatttttatagtgtgtttggaagcccgtttgagaaaataagaaatcgcatctggaatgtgaaagttataactatttagcttcatttgtcgttgcaagttcttttattggttaaatttttatagcgtgctaggaaacccattcgagaaaataagaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgatt

SEQ ID NO: 3349 - DNA, 769 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagcccttttcagatagcattcctcaattcttgtgccataccatggatggttagttcatactggcttttttgtttgttcatttgtcattgaaaaaaactcttttgttgattcaattatttttatagtgtgtttggaagcccgtttgagaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagtcacagaactcaccatcaaaaccatggacacattgagaaggatgagtcatgggttccagtatgtgattaattgcttctcctatagttgttcttgattcaattacattttatttatttggtagggtccaagaaaaaaagggaatcttttagcttcctgaggctgtttcttgaacatggctcttttttatgtgcattatcttagttaa

SEQ ID NO: 3350 - DNA, 648 bp, Artificial
  Glycine max FAD3B mutation created with TALEN pair GmFAD3_T02.1
ctcacacattgttctgttatgtcatttcttcttcatttggctttagacaacttaaatttgagatctttattatgttttttgcttatatggtaaagtgattcttcattatttcattcttcattgattgaattgaacagtggccatggaagcttttcagatagccctttgctgaatagcctggtggggacagcattcctcaattcttgtgccataccatggatggttagttcatactggcttttttgtttgttcatttgtcattgaaaaaaaagtcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttgattttgataaatgacaaccaaattgattttgatggattttgcaggagaattagccacagaactcaccatcaaaaccatggacacattgagaaggatgagtcatgggttccagtatg

SEQ ID NO: 3351 - DNA, 705 bp, Artificial
  Glycine max FAD3B mutation created with TALEN pair GmFAD3_T02.1
ctcacacattgttctgttatgtcatttcttcttcatttggctttagacaacttaaatttgagatctttattatgttttttgcttatatggtaaagtgattcttcattatttcattcttcattgattgaattgaacagtggccatggaagcttttcagatagccctttgctgaatagcctggtggggacattgcattcctcaattcttgtgccataccatggatggttagttcatactggcttttttgtttgttcatttgtcattgaaaaaaaagtcttttgttgattcaattatttttatagtgtgtttggaagcccgtttgagaaaaattaagaaaatcgcatctggaatgtgaaaagttataactatttagcttcatttgtcgttgcaagttcttttattggttaaatttttatagcgtgctaggaaacccattcgagaaaagtaagaaattcacatctggaatgtgaaagttataactgttagcttctgagtaaacgtggaaaaatccacattttggatttaggaaccaaattttgattttgataaattgacaaccaaagttgattttgatggattttgcaggagaattagccacagaactcaccatcaaaagccatggacacattgagaaggatgagtcatgggttccagtatgtgattaattgcttctcctatagttgttcttgattcaattacatttta

SEQ ID NO: 3352 - DNA, 679 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatagtgtgtttggaagcccgtttgagaaaataagaaatcgcatctggaatgtgaaagttataactatttagcttcatttgtcgttgcaagttcttttattggttaaatttttatagcgtgctaggaaaacccattcgagaaaataagaaaatcacatctggaatgtgaaaagttataactgttagcttctgagtaaacgtggaaaaaaccacatttttggatttggaaaccaaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaaagggaatctttatgcttcctgagggctgttcttgaacatgactctttttatgtgtcattatcttag

SEQ ID NO: 3353 - DNA, 687 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacagcattcctcaattcttgtgccataccatggatggttagttcatactggcttttttgtttgttcatttgtcattgaaaaaaaagtcttttgttgattcaattatttttatagtgtgtttggaagcccgtttgagaaaaataagaaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaagccatggacacattgagaaggatgagtcatgggttccagtatgtgattaattgcttctcctatagttgttcttgattcaattaca

SEQ ID NO: 3354 - DNA, 703 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacagcattcctcaattcttgtgccataccatggatggttagttcatactggcttttttgtttgttcatttgtcattgaaaaaaaagtcttttgttgattcaattatttttatagtgtgtttggaagcccgtttgagaaaaataagaaatcgcatctggaatgtgaaagttataactattagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggt

SEQ ID NO: 3355 - DNA, 767 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacataccatggatggttagttcatactggcttttttgtttgttcatttgtcattgaaaaaaactcttttgttgattcaattatttttatagtgtgtttggaagcccgtttgagaaaattaagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaaaatgggaagtcttttagcttcctgaggtctgttcttgaacatgggctcttttttatgtgtcattatcttagtttaa

SEQ ID NO: 3356 - DNA, 772 bp, Artificial
  Glycine max FAD3B mutation created with TALEN pair GmFAD3_T02.1
ctcacacattgttctgttatgtcatttcttcttcatttggctttagacaacttaaatttgagatctttattatgttttttgcttatatggtaaagtgattcttcattatttcattcttcattgattgaattgaacagtggccatggaagcttttcagatagccctttgctgaatagcctggtggggacacattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaagggtaatctttatgcattcctgaggctgttcttgaacatggctcttttttatgtgtca

SEQ ID NO: 3357 - DNA, 792 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacatcctcaattctttgtcgtccatcaatcctatggcatgctagttcgatgtgtctactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaaccatggacacattgagaaggatgagtcatgggttccagtatgtgattaattgcttctcctatagttgttcttgattcaattacattttatttatttggtaggtccaagaaaaagggaatctttatgcttcctgaggctgttcttgaacatggctcttttttatgtgtcattatcttagttaa

SEQ ID NO: 3358 - DNA, 762 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacataccatggatggttagttcatactggcttttttgtttgttcatttgtcattgaaaaaaactcttttgttgattcaattatttttatagtgtgtttggaagcccgtttgagaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaaccatggacacattgagaaggatgagtcatgggttccagtatgtgattaattgcttctcctatagttgttcttgattcaattacattttatttatttggtaggtccaagaaaaaagggaatctttatgcattcctgaggtctgttcttgaacatggctcttttttatgtgtcattatcttagttaa

SEQ ID NO: 3359 - DNA, 711 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggactcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaatccacattttggatttggaaccaaattttgatttgataaatgacaaccaaattgattttgatggattttgcaggagaattagccacagaactcaccatcaaaagccatggacacattgagaaggatgagtcatgggttccagtatgtgattaattgcttctcctatagttgttcttgattcaattacattttatttatttggtaggtccaagaaaaatggg

SEQ ID NO: 3360 - DNA, 677 bp, Artificial; identical to SEQ ID NO: 3257
  Glycine max FAD3B mutation created with TALEN pair GmFAD3_T02.1

SEQ ID NO: 3361 - DNA, 665 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacggaagcccgtttgagaaataagaaatcgcatctggaatgtgaaagttataactatttagcttcatttgtcgttgcaagttcttttattggttaaaatttttatagcgtgctaggaaacccattcgagaaaaataagaaatcacatctggaatgtgaaaagttataactgttagcttctgagtaaacgtggaaaaaccacattttggatttggaaccaaattttatttgataaatgacaaccaaattgattttgatggattttgcaggagaattagccacagaactcaccattcaaaaacctggacacattgagaagatgagtcatgggttccagtatgtgattaattgcttctcctatagttgttcttgattcaattacatttatttatttgggtaggtccaagaaaaaaagggaatctttatgcttcctgaggctgttcttgaacatggctctttttatgtgtcattatcttagttaa

SEQ ID NO: 3362 - DNA, 729 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtggggacagcattcctcaattcttgtgccataccatggatggttagttcatactggctttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggaatctttatgc

SEQ ID NO: 3363 - DNA, 773 bp, Artificial
  Glycine max FAD3B mutation created with TALEN pair GmFAD3_T02.1
ctcacacattgttctgttatgtcatttcttcttcatttggctttagacaacttaaatttgagatctttattatgttttttgcttatatggtaaagtgattcttcattatttcattcttcattgattgaattgaacagtggccatggaagcttttcagatagccctttgctgaatagcctggtggggacacattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaagggtaatctttatgcattcctgaggtctgttcttgaacatggctcttttttatgtgtca

SEQ ID NO: 3364 - DNA, 781 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacttcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggaatctttatgcattcctgaggctgttcttgaacatggctcttttttatgtgtcatttatcttagttaa

SEQ ID NO: 3365 - DNA, 750 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacattcctcaattcttgtgccataccatggatggttagttcatactggcttttttgtttgttcatttgtcattgaaaaaaaagtcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaagccatggacacattgagaaggatgagtcatgggttccagtatgtgattaattgcttctcctatagttgttcttgattcaattacattttatttatttggtaggtccaagaaaaaatgggaatctttatgcttcctgaggctgttcttgaa

SEQ ID NO: 3366 - DNA, 778 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacaattcttgtgccataccatggatggttagttcatactggcttttttgtttgttcatttgtcattgaaaaaaatcttttgttgattcaattatttttatagtgtgtttggaagcccgtttgagaaaataagaaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggttccaagaaaaaagggtaatcttttatgcattcctgaggtctgttcttgaacatggctcttttttatgtgtcattatcttagttaa

SEQ ID NO: 3367 - DNA, 787 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtggtttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaaagggtaatctttatgcattcctgaggctgttcttgaacatggctcttttttatgtgtcatttatcttagttaa

SEQ ID NO: 3368 - DNA, 788 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggattgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaaagggtaatcttttaatggcttcctgaggtctgttcttgaacatggctcttttttatgtgtcatatcttagttaa

SEQ ID NO: 3369 - DNA, 757 bp, Artificial
  Glycine max FAD3B mutation created with TALEN pair GmFAD3_T02.1
  misc_feature (297): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacactgtcatttgccattccattcattgttgcgcataccatggatggttagttcatactggcttttttgtttgttcatttgtcattgaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggaatctttatgcttcctgaggctgttcttgaaca

SEQ ID NO: 3370 - DNA, 792 bp, Artificial
  Glycine max FAD3B mutation created with TALEN pair GmFAD3_T02.1
  misc_feature (749); (759): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacactgcattgcctccattcattgttgcgcataccatggatggttagttcatactggcttttttgtttgttcatttgtcattgaaaaaaaagtcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaagccatggacacattgagaaggatgagtcatgggttccagtatgtgattaattgcttctcctatagttgttcttgattcaattacattttatttatttggtaggtccaagaaaaaatgggaatcttttatgcttcctgaggctnttcttgaacntggctcttttttatgtgcattatcttagtttaa

SEQ ID NO: 3371 - DNA, 790 bp, Artificial
  Glycine max FAD3B mutation created with TALEN pair GmFAD3_T02.1
ctcacacattgttctgttatgtcatttcttcttcatttggctttagacaacttaaatttgagatctttattatgttttttgcttatatggtaaagtgattcttcattatttcattcttcattgattgaattgaacagtggccatggaagcttttcagatagccctttgctgaatagcctggtggggacacattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaaaagggtaatctttatgcattcctgaggctgttcttgaacatggctcttttttatgtgtcatttatcttagttaa

SEQ ID NO: 3372 - DNA, 795 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacttgcattcctcaattcttgtgccataccatggatggttagttcatactggcttttttgtttgttcatttgtcattgaaaaaaaagtcttttgttgattcaattatttttatagtgtgtttggaagcccgtttgagaaaaataagaaatcgcatctggaatgtgaaaagttataactatttagcttcatttgtcgttgcaagttcttttattggttaaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaaaatgggaagtctttatgcttcctgaggctgttctttgaacatggcttcttttttaatgtgcatttatcttagttaa

SEQ ID NO: 3373 - DNA, 785 bp, Artificial
  Glycine max FAD3B mutation created with TALEN pair GmFAD3_T02.1
  misc_feature (290): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttcctcattcattgttgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaagccatggacacattgagaaggatgagtcatgggttccagtatgtgattaattgcttctcctatagttgttcttgattcaattacattttatttatttggtagggtccaagaaaaagggaatctttatgcttcctgaggctgttcttgaacatggctcttttttatgtgtcattatcttagttaa

SEQ ID NO: 3374 - DNA, 715 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaagggtaa

SEQ ID NO: 3375 - DNA, 790 bp, Artificial
  Glycine max FAD3B mutation created with TALEN pair GmFAD3_T02.1
  misc_feature (295): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacactgcattgccttccattcattgttgcgcataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaaagggaatctttatgcttcctgaggctgttcttgaacatggctcttttttatgtgtcattatcttagttaa

SEQ ID NO: 3376 - DNA, 790 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacactgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtcccaagaaaaaagggtaatctttatgcattcctgaggtctgttcttgaacatggctcttttttatgtgtcatttatcttagttaa

SEQ ID NO: 3377 - DNA, 769 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggattcctcaattcttgtgccataccatggatggttagttcatactggcttttttgtttgttcatttgtcattgaaaaaaaatcttttgttgattcaattatttttatagtgtgtttggaagcccgtttgagaaaataagaaatcgcatctggaatgtgaaagttataactatttagcttcatttgtcgttgcaagttcttttattggttaaatttttatagcgtgctaggaaacccattcgagaaaataagaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacatttttatttatttgggtagggtcccaagaaaaaagggtaatctttatgcattcctgaggtctgttcttgaacatggctcttttttatgtgtca

SEQ ID NO: 3378 - DNA, 785 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacagcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaagggtgagtcatgggttccagtatgtgattaattgcttctcctatagttgttcttgattcaattacattttatttatttggtagggtccaagaaaaaagggtaatctttatgcattcctgaggctgttcttgaacatggctcttttttatgtgtcatttatcttagttaa

SEQ ID NO: 3379 - DNA, 784 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacaagcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaagggaatctttatgcttcctgaggctgttcttgaacatgggctcttttttatgtgtcatatctagttaa

SEQ ID NO: 3380 - DNA, 707 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacattcctcaattcttgtgccataccatggatggttagttcatactggcttttttgtttgttcatttgtcattgaaaaaaaagtcttttgttgattcaattatttttatagtgtgtttggaagcccgtttgagaaaaattaagaaaatcgcatctggaatgtgaaaagttataactatttagcttcatttgtcgttgcaagttcttttattggttaaatttttatagcgtgctaggaaacccattcgagaaaaataagaaatcacatctggaatgtgaaagttataactgttagcttctgagtaaacgtggaaaaaccacattttggatttggaaccaaattttgatttgataaatgacaaccaaattgattttgatggattttgcaggagaattagccacagaactcaccatcaaaagccatggacacattgagaaggatgagtcatgggttccagtatgtgattaattgcttctcctatagttgttcttgattcaattacattttatttatttggtagggt

SEQ ID NO: 3381 - DNA, 767 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacatttttatttatttggtagggtccaagaaaaagggtaatctttatgcattcctgaggtctgttcttgaacatggctcttttttatgtgtca

SEQ ID NO: 3382 - DNA, 775 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggtgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacatttttatttatttgggtagggtcccaagaaaaaagggtaatctttatgcattcctgaggtctgttcttgaacatggctcttttttatgtgtca

SEQ ID NO: 3383 - DNA, 752 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacgcattcctcaattcttgtgccataccatggatggttagttcatactggcttttttgtttgttcatttgtcattgaaaaaaaagtcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaagccatggacacattgagaaggatgagtcatgggttccagtatgtgattaattgcttctcctatagttgttcttgattcaattacattttatttatttggtaggtccaagaaaaatgggaatctttatgcttcctgaggctgttcttgaaca

SEQ ID NO: 3384 - DNA, 779 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacaacggtccagcggctgttgccggtgctgtgccaggcccacggcttgaccccccagcaggtggcattcctcaattcttgtgccataccatggatggttagttcatactggctttttgtttgttcatttgtcattgaaaaaaatcttttgttgattcaattatttttatagtgtgtttggaagcccgtttgagaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttgggatttggaaccaaaatttatttgataaatgacaaccaaattgatttgatggattttgcaggagaattagccacagaatctcaccatcaaaaccatggacacattgagaaggatgagtcatgggttccagtatgtgattaattgcttctcctatagttgttcttgattcaattacattttatttatttggtaggtccaagaaaaagggaatc

SEQ ID NO: 3385 - DNA, 770 bp, Artificial
  Glycine max FAD3B mutation created with TALEN pair GmFAD3_T02.1
ctcacacattgttctgttatgtcatttcttcttcatttggctttagacaacttaaatttgagatctttattatgttttttgcttatatggtaaagtgattcttcattatttcattcttcattgattgaattgaacagtggccatggaagcttttcagatagccctttgctgaatagcctggtgggacacatcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaaaagggtaatctttatgcttcctgaggctgttcttgaacatggctcttttttatgtgca

SEQ ID NO: 3386 - DNA, 432 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttcttgcattcctcaattcttgtgccataccatggatggttagttcatactggcttttttgtttgttcatttgtcattgaaaaaaatcttttgttgattcaattatttttatagtgtgtttggagcccgtttgagaaaataagaaatcgcatctggaatgtgaaagttataactatttagcttcatttgtcgttgcaagttcttttattggttaaatttttatagcgtgcttaggaaaccc

SEQ ID NO: 3387 - DNA, 786 bp, Artificial
  Glycine max FAD3B mutation created with TALEN pair GmFAD3_T02.1
ctcacacattgttctgttatgtcatttcttcttcatttggctttagacaacttaaatttgagatctttattatgttttttgcttatatggtaaagtgattcttcattatttcattcttcattgattgaattgaacagtggccatggaagcttttcagatagccctttgctgaatagcctggtgggacagcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaagggtaatctttatgcattcctgaggctgttcttgaacatggctcttttttatgtgtcatttatcttagttaa

SEQ ID NO: 3388 - DNA, 785 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggattgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaagggtaatctttatgcattcctgaggtctgttcttgaacatggctcttttttatgtgtcattatcttagttaa

SEQ ID NO: 3389 - DNA, 784 bp, Artificial
  Glycine max FAD3B mutation created with TALEN pair GmFAD3_T02.1
ctcacacattgttcttgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgttgcattcctcaattcttgtgccataccatggatggttagttcatactggctttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaagggtaatctttatgcattcctgaggtctgttcttgaacatggctcttttttatgtgtcattatcttagttaa

SEQ ID NO: 3390 - DNA, 778 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttgtatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaaatgggaatctttatgcttcctgaggctgttcttgaacatggctcttttttatgtgcattatctta

SEQ ID NO: 3391 - DNA, 774 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttcttgcattcctcaattcttgtgccataccatggatggttagttcatactggcttttttgtttgttcatttgtcattgaaaaaaaactcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggattttgggaaccaaattttatttgataaatgacaaccaaattgattttgatggattttgcaggagaatttagccacagaactcaccatcaaaaccatggacacattgagaaggatgagtcatgggttccagtatgtgattaattgcttctcctatagttgttcttgattcaattacattttatttatttggtaggtccaagaaaaagggtaatctttatgcttcctgaggctgttcttgaacatggctcttttt

SEQ ID NO: 3392 - DNA, 758 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacaattcttgtgccataccatggatggttagttcatactggcttttttgtttgttcattgtcattgaaaaaaatcttttgttgattcaattatttttatagtgtgttttggaagcccgtttgagaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggaatctttatgcattcctgaggtctgttcttgaacatggctcttttttatgtgtca

SEQ ID NO: 3393 - DNA, 786 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacactgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaaagggaatctttatgcttcctgaggctgttcttgaacatggctcttttttatgtgtcatttatcttagttaa

SEQ ID NO: 3394 - DNA, 783 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggaccattcctcaattcttgtgccataccatggatggttagttcatactggctttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaagggtaatctttatgcattcctgaggctgttcttgaacatggctcttttttatgtgtcattatcttagttaa

SEQ ID NO: 3395 - DNA, 723 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgttgaatagcctggtgggacacagcattcctcaattcttgtgccataccatggatggttagttcatactggcttttttgtttgttcatttgtcattgaaaaaaaagtcttttgttgattcaattatttttatagtgtgtttggaagcccgtttgagaaaaattaagaaatcgcatctggaatgtgaaagttataactatttagcttcatttgtcgttgcaagttcttttattggttaaatttttatagcgtgctaggaaaacccattcgagaaaataagaaatcacatctggaatgtgaaagttataactgttagcttctgagtaaacgtggaaaaatccacattttggatttggaaccaaattttgatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaatggg

SEQ ID NO: 3396 - DNA, 751 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggagcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaatccacattttggatttggaaccaaaattttatttgataaatgacaaccaaattgattttgatggattttgcaggagaattagccacagaactcaccatcaaaaccatggacacattgagaaggattgagtcaatgggttccagtatgtgattaattgcttctcctatagttgttcttgattcaattacattttatttattggtaggtccaagaaaaagggaatctttatgcattcctgaggctgttcttgaacat

SEQ ID NO: 3397 - DNA, 784 bp, Artificial
  Glycine max FAD3B mutation created with TALEN pair GmFAD3_T02.1
ctcaattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggtaatctttatgcattcctgaggctgttcttgaacatggctcttttttatgtgtcatttatcttagttaa

SEQ ID NO: 3398 - DNA, 783 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtcccaagaaaaagggatctttatgcttcctgaggctgttcttgaacatggctcttttttatgtgtcattatcttagttaa

SEQ ID NO: 3399 - DNA, 766 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacgcattcctcaattcttgtgccataccatggatggttagttcatactggcttttttgtttgttcatttgtcattgaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaaaatgggtaatcttttatgcttcctgaggctgttcttgaacatggctctttttt

SEQ ID NO: 3400 - DNA, 712 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacagcattgccttccattcattgttgcgcataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaattcacatctggaatgtgaaagttataactgttagcttctgagtaaacgtggaaaaaccacattttggatttggaaccaaattttattttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggt

SEQ ID NO: 3401 - DNA, 780 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggactcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggtaatctttatgcattcctgaggtctgttcttgaacatggctcttttttatgtgtcattatcttagttaa

SEQ ID NO: 3402 - DNA, 706 bp, Artificial
  Glycine max FAD3B mutation created with TALEN pair GmFAD3_T02.1
  misc_feature (295): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacactgcattgccttccattcattgttgcgcataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggta

SEQ ID NO: 3403 - DNA, 677 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggagattcctcaattcttgtgccataccatggatggttagttcatactggcttttttgtttgttcatttgtcattgaaaaaaaagtcttttgttgattcaattatttttatagtgtgtttggaagcccgtttgagaaaaattaagaaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaatccacattttggatttggaaccaaaattttgatttgataaaattgacaaccaaagttgattttgatggattttgcaggagaattagccacagaactcaccatcaaaaagccatggacacattgagaaggatgagtcatgggttccagtatgtgattaattgcttctcctatagttgtt

SEQ ID NO: 3404 - DNA, 685 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggattgcattcctcaattcttgtgccataccatggatggttagttcatactggctttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaagccatggacacattgagaaggatgagtcatgggttccagtatgtgattaattgcttctcctatagttgttcttgattcaattaca

SEQ ID NO: 3405 - DNA, 702 bp, Artificial; identical to SEQ ID NO: 3298
  Glycine max FAD3B mutation created with TALEN pair GmFAD3_T02.1

SEQ ID NO: 3406 - DNA, 766 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtggggcattcctcaattcttgtgccataccatggatggttagttcatactggctttttttgtttgttcatttgtcattgaaaaaaaatcttttgttgattcaattatttttatagtgtgtttggaagcccgtttgagaaaaataagaaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaaaagggtaatctttatgcattcctgaggctgttcttgaacatggctctttttt

SEQ ID NO: 3407 - DNA, 718 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattatttcattcctcaattcttgtgccataccatggatggttagttcatactggcttttttgtttgttcatttgtcattgaaaaaaatcttttgttgattcaattatttttatagtgtgtttggaagcccgtttgagaaaataagaaatcgcatctggaatgtgaaagttataactatttagcttcatttgtcgttgcaagttcttttattggttaaatttttatagcgtgctaggaaaacccattcgagaaaataagaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaaccatggacacattgagaaggatgagtcatgggttccagtatgtgattaattgcttctcctatagttgttcttgattcaattacattttatttatttggtaggtccaagaaaaaaaggggaatctttatgcttcctgaggctgttcttgaacatggctcttttttatgtgtcattatcttagtt

SEQ ID NO: 3408 - DNA, 686 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggtaaatttttatagcgtgctaggaaacccattcgagaaaataagaaatcacatctggaatgtgaaagttataactgttagcttctgagtaaacgtggaaaaaccacattttggatttggaaccaaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattaca

SEQ ID NO: 3409 - DNA, 788 bp, Artificial
  Glycine max FAD3B mutation created with TALEN pair GmFAD3_T02.1
  misc_feature (298): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcgtttgccattccattcattgcttgcgcataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaagggaatcttttatgcttcctgaggctgttcttgaacatggctcttttttatgtgcattatcttag

SEQ ID NO: 3410 - DNA, 691 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatgcattcctcaattcttgtgccataccatggatggttagttcatactggcttttttgtttgttcatttgtcattgaaaaaaaagtcttttgttgattcaattatttttatagtgtgtttggaagcccgtttgagaaaaattaagaaaatcgcatctggaatgtgaaaagttataactatttagcttcatttgtcgttgcaagttcttttattggttaaatttttatagcgtgctaggaaacccattcgagaaaaagtaagaaattcacatctggaatgtgaaagttataactgttagcttctgagtaaacgtggaaaaaatccacattttggatttggaaccaaaattttgatttgataaatgacaaccaaattgattttgatggattttgcaggagaattagccacagaactcaccatcaaaagccatggacacattgagaaggatgagtcatgggttccagtatgtgattaattgcttctcctatagttgttcttgattc

SEQ ID NO: 3411 - DNA, 693 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggatgcattcctcaattcttgtgccataccatggatggttagttcatactggcttttttgtttgttcatttgtcattgaaaaaaaagtcttttgttgattcaattatttttatagtgtgtttggaagcccgtttgagaaaaattaagaaaatcgcatctggaatgtgaaaagttataactatttagcttcatttgtcgttgcaagttcttttattggttaaatttttatagcgtgctaggaaacccattcgagaaaaataagaaatcacatctggaatgtgaaagttataactgttagcttctgagtaaacgtggaaaaatccacattttggatttggaaccaaaattttgattttgataaatgacaaccaaattgattttgatggattttgcaggagaattagccacagaactcaccatcaaaagccatggacacattgagaaggatgagtcatgggttccagtatgtgattaattgcttcctcctatagttgttcttgattcaattaca

SEQ ID NO: 3412 - DNA, 792 bp, Artificial
  Glycine max FAD3B mutation created with TALEN pair GmFAD3_T02.1
  misc_feature (299): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggagcattcctcaattctttgtgtccataatcctatggcatggcttagttcgatgatgtctggctttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggaatctttatgcttcctgaggctgttcttgaacatggctcttttttatgtgtcattatcttagttaa

SEQ ID NO: 3413 - DNA, 772 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtcccaagaaaaaagggaatcttttagcttccgaggctgttcttgaacatggctcttttttatgtgca

SEQ ID NO: 3414 - DNA, 775 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacgcattgccttccattcattgttgcgcataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaaagggaatctttatgcttcctgaggctgttcttgaacatggctcttttttatgtgtca

SEQ ID NO: 3415 - DNA, 497 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacattcctcaattcttgtgccataccatggatggttagttcatactggctttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaacc

SEQ ID NO: 3416 - DNA, 779 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacgcattcctcaattcttgtgccataccatggatggttagttcatactggcttttttgtttgttcatttgtcattgaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaaagaaaaaagggtaatctttatgcattcctgaggtctgttcttgaacatggctcttttttatgtgtcatttatc

SEQ ID NO: 3417 - DNA, 764 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaaaatgggaatcttttatgcttcctgaggctgttcttgaacatggctctttttt

SEQ ID NO: 3418 - DNA, 586 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcaacgcggccaacgccggatcagggcgagataactgggcaacaatgctctccagcgccggcctgccgccgccattgctggcgatggccaccacctgctgaggggtttgcattcctcaattcttgtgccataccatggatggttagttcatactggctttttcgtttgttcatttgtcattgaaaaaaagtcttttgttgattcaattatttttatagtgtgtttggaaagcccgtttgagaaaaagtaagaaatcgcatctggaatgtgaaagttataactatttagcttcatttgtcgttgcaagttcttttattggttaaaattttatagcgtgctaggaaacccaattcgagaaaaattaaggaaatcacatctggaatgtgaaagttataac

SEQ ID NO: 3419 - DNA, 773 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtggtttgcattcctcaattcttgtgccataccatggatggttagttcatactggctttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggaatctttatgcttcctgaggctgttcttgaacatggctcttttttatgtgcattatc

SEQ ID NO: 3420 - DNA, 793 bp, Artificial
  Glycine max FAD3B mutation created with TALEN pair GmFAD3_T02.1
  misc_feature (300): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtggggacactgtcatttgccattccattcattgcttgcgcataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggaatctttatgcttcctgaggctgttcttgaacatggctcttttttatgtgtcattatcttagttaa

SEQ ID NO: 3421 - DNA, 772 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacgcattgccttccattcattgttgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtcccaaagaaaaaaagggaatctttatgcattcctgaggctgttcttgaacatggctcttttt

SEQ ID NO: 3422 - DNA, 702 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattatttcattcctcaattcttgtgccataccatggatggttagttcatactggcttttttgtttgttcatttgtcattgaaaaaaatcttttgttgattcaattatttttatagtgtgtttggaagcccgtttgagaaaataagaaatcgcatctggaatgtgaaagttataactatttagcttcatttgtcgttgcaagttcttttattggttaaatttttatagcgtgctaggaaaacccattcgagaaaataagaaatcacatctggaatgtgaaagttataactgttagcttctgagtaaacgtggaaaaaaccacattttggatttggaaccaaattttatttgataaatgacaaccaaattgattttgatggattttgcaggagaattagccacagaactcaccatcaaaaaccatggacacattgagaaggatgagtcatgggttccagtatgtgattaattgcttctcctatagttgttcttgattcaattacattttatttatttggtaggtccaagaaaaaaaggggaatctttatgcttcctgaggctgttcttgaacatggctctttttta

SEQ ID NO: 3423 - DNA, 791 bp, Artificial
  Glycine max FAD3B mutation created with TALEN pair GmFAD3_T02.1
  misc_feature (295): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacactgcatttgcctccattcattgttgcgcataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttattttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaaagggaatctttatgcgttcctgaggctgttcttgaacatggctcttttttaatgtgcatttatctagttaa

SEQ ID NO: 3424 - DNA, 791 bp, Artificial
  Glycine max FAD3B mutation created with TALEN pair GmFAD3_T02.1
  misc_feature (298): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtggggacactgcatttgccattccattcattgttgcgcataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggaatctttatgcttcctgaggctgttcttgaacatggctcttttttatgtgtcattatcttagttaa

SEQ ID NO: 3425 - DNA, 741 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacagcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacatttttatttatttggtagggtccaagaaaaaagggtaatcttttatgcattcctga

SEQ ID NO: 3426 - DNA, 789 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacactgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaaagaaaaaaagggaatctttatgcattcctgaggctgttcttgaacatggctcttttttatgtgtcatttatcttagttaa

SEQ ID NO: 3427 - DNA, 777 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacagcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtcccaaagaaaaaagggtaatctttatgcattcctgaggtctgttcttgaacatggctcttttttatgtgtca

SEQ ID NO: 3428 - DNA, 684 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggaagcattcctcaattcttgtgccataccatggatggttagttcatactggctttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaagccatggacacattgagaaggatgagtcatgggttccagtatgtgattaattgcttctcctatagttgttcttgattcaattaca

SEQ ID NO: 3429 - DNA, 677 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaaggcttttcagatagccctttgctgaatagcctggtgggacacttgcattcctcaattcttgtgccataccatggatggttagttcatactggcttttttgtttgttcatttgtcattgaaaaaaaatcttttgttgattcaattatttttatagtgtgtttggaagcccgtttgagaaaataagaaatcgcatctggaatgtgaaagttataactatttagcttcatttgtcgttgcaagttcttttattggttaaatttttatagcgtgctaggaaacccattcgagaaaataagaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgatt

SEQ ID NO: 3430 - DNA, 835 bp, Artificial
  Glycine max FAD3B mutation created with TALEN pair GmFAD3_T02.1
  misc_feature (602): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatgttgccggtgctgtgccaggcccacggcttgaccccggagcaggtggtggccatcgccagcaatattcctcaattcttgtgccataccatggatggttagttcatactggcttttttgtttgttcatttgtcattgaaaaaaaatcttttgttgattcaattattttatagtgtgtttggaagcccgtttgagaaaataagaaatcgcatctggaatgtgaaagttataactatttagcttcatttgtcgttgcaagttcttttattggttaaatttttatagcgtgctaggaaacccattcgagaaaattaagaaatcacatctggaatgtgaaagttataactgttagcttctgagtaaacgtggaaaaaccacattttggatttggaaccaaatttattgataaaatgncaaccaaattgatttgatggattttgcaggagaattagccacagaatctcaccatcaaaaccatggacacattgagaaggatgagtcatgggttccaagtatgtgattaattgcttctcctatagttgttcttgattcaattacatttttatttatttggtaggtccaagaaaaagggaatctttatgcttcctgaggctgttcttgaacatggctcttttttatgtgtcatt

SEQ ID NO: 3431 - DNA, 745 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatctatcgcgtattaaatgtataattgcgggactctaatcataaaaacccatctcataaataacgtcatgcattacatgttaattattacatgcttaacgtaatactggcttttttgtttgttcatttgtcattgaaaaaaaattcttttgttgattcaattatttttatagtgtgttttgggaaagcccgttttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttgggatttggaaccaaatttatttgataaatgacaaccaaattgatttgatggattttgcaggagaattagccacagaactcaccatcaaaatccatggacacattgagaaggatgagtcatgggttccagtatgtgattaattgcttctcctatagttgttcttgattcaa

SEQ ID NO: 3432 - DNA, 789 bp, Artificial
  Glycine max FAD3B mutation created with TALEN pair GmFAD3_T02.1
ctcacacattgttctgttatgtcatttcttcttcatttggctttagacaacttaaatttgagatctttattatgttttttgcttatatggtaaagtgattcttcattatttcattcttcattgattgaattgaacagtggccatggaagcttttcagatagccctttgctgaatagcctggtggggacattgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaagggaatctttatgcattcctgaggctgttcttgaacatggctcttttttatgtgtcatttatcttagttaa

SEQ ID NO: 3433 - DNA, 779 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtcccaagaaaaaaagggtaatctttatgcattcctgaggtctgttcttgaacatggctcttttttatgtgtca

SEQ ID NO: 3434 - DNA, 767 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctgggttgcattcctcaattcttgtgccataccatggatggttagttcatactggcttttttgtttgttcatttgtcattgaaaaaaatcttttgttgattcaattatttttatagtgtgtttggaagcccgtttgagaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacatttttatttatttggtagggtcccaagaaaaaagggaatctttatgcattcctgaggtctgttcttgaacatggctcttttttatgtgtcattatcttagttaa

SEQ ID NO: 3435 - DNA, 780 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacttgcattcctcaattcttgtgccataccatggatggttagttcatactggcttttttgtttgttcatttgtcattgaaaaaaaagtcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttgatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaatgggaatctttatgcttcctgaggctgttcttgaacatggctcttttttatgtgcattatc

SEQ ID NO: 3436 - DNA, 767 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacagcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtcccaagaaaaaagggtaatctttatgcattcctgaggctgttcttgaacatggctctttttt

SEQ ID NO: 3437 - DNA, 772 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacagcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggtatctttatgcattcctgaggtctgttcttgaacatggctcttttttatgtgtca

SEQ ID NO: 3438 - DNA, 793 bp, Artificial
  Glycine max FAD3B mutation created with TALEN pair GmFAD3_T02.1
  misc_feature (298): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtggggacactgtcatttgccttccattcattgttgcgcataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaatttttattttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaatgggaatctttatgcttcctgaggctgttcttgaacatggctcttttttatgtgcattatcttagttaa

SEQ ID NO: 3439 - DNA, 788 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacagcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtcccaagaaaaagggtaatctttatgcattcctgaggctgttcttgaacatggctcttttttatgtgtcatttatcttagttaa

SEQ ID NO: 3440 - DNA, 678 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattc

SEQ ID NO: 3441 - DNA, 769 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctgtgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtcccaagaaaaaaatgggtaatcttttatgcttcctgaggctgttcttgaacatggctcttttttatgtgca

SEQ ID NO: 3442 - DNA, 794 bp, Artificial
  Glycine max FAD3B mutation created with TALEN pair GmFAD3_T02.1
  misc_feature (302): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtggggacactagtcatttgccattccattcatttgcttgcgcataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttattggtagggtccaagaaaaagggaatctttatgcttcctgaggctgttcttgaacatggctcttttttatgtgtcattatctagttaa

SEQ ID NO: 3443 - DNA, 780 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaagccatggacacattgagaaggatgagtcatgggttccagtatgtgattaattgcttctcctatagttgttcttgattcaattacattttatttatttggtagggtccaagaaaaaaatgggaatcttttatgcttcctgaggctgttcttgaacatggctctttttttatgtgtcatatcttag

SEQ ID NO: 3444 - DNA, 759 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacataccatggatggttagttcatactggcttttttgtttgttcatttgtcattgaaaaaaatcttttgttgattcaattattttaatagtgtgtttggaagcccgtttgagaaaattaagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaagggaatcttttagcttcctgaggtctgttcttgaacatggctcttttttatgtgtcatatcttagttaa

SEQ ID NO: 3445 - DNA, 695 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacaaattcctcaattcttgtgccataccatggatggttagttcatactggcttttttgtttgttcatttgtcattgaaaaaaaagtcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaatccacattttggatttggaaccaaattttgatttgataaatgacaaccaaattgattttgatggattttgcaggagaattagccacagaactcaccatcaaaaagccatggacacattgagaaggatgagtcatgggttccagtatgtgattaattgcttctcctatagttgttcttgattcaattacattttattt

SEQ ID NO: 3446 - DNA, 784 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggactcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaagggaatctttatgcttcctgaggctgttcttgaacatggctcttttttatgtgcattatcttagttaa

SEQ ID NO: 3447 - DNA, 767 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaaacccattcgagaaaaataagaaatcacatctggaatgtgaaagttataactgttagcttctgagtaaacgtggaaaaaccacattttggatttggaaccaaaattttatttgataaatgacaaccaaattgattttgatggattttgcaggagaattagccacagaactcaccatcaaaaccatggacacattgagaaggatgagtcaatgggttccagtatgtgattaattgcttctcctatagttgttcttgattcaaattacatttttatttatttggtaggtccaagaaaaagggtaatctttatgcattcctgaggctgttcttgaacatggctctttttta

SEQ ID NO: 3448 - DNA, 770 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacagcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaaccatggacacattgagaaggatgagtcatgggttccagtatgtgattaattgcttctcctatagttgttcttgattcaattacattttatttatttggtagggtccaagaaaaaaagggtaatctttatgcattcctgaggtctgttcttgaacatggctctttttt

SEQ ID NO: 3449 - DNA, 511 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacagcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagtttctgagtaaacgtggaaaaaccacattttgg

SEQ ID NO: 3450 - DNA, 703 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgcattcctcaattcttgtgccataccatggatggttagttcatactggcttttttgtttgttcatttgtcattgaaaaaaactcttttgttgattcaattattttaatagtgtgtttggaagcccgtttgagaaaattaagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaatccacattttggatttggaaccaaaattttatttgataaatgacaaccaaatttgattttgatggattttgcaggagaattagccacagaactcaccatcaaaaagccatggacacattgagaaggatgagtcatgggttccagtatgtgattaattgcttctcctatagttgttcttgattcaattacatttttatttatttggtagggtcccaaagaaaaaaaa

SEQ ID NO: 3451 - DNA, 766 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacagcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtcccaagaaaaaagggtaatctttatgcattcctgaggctgttcttgaacatggctcttttt

SEQ ID NO: 3452 - DNA, 629 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacaccttggtgtccacgatcacgccgtagtcgatgggggagcccacggtgtagatggcgccgtcgggctcgcattcctcaattcttgtgccataccatggatggttagttcatactggctttttgtttgttcatttgtcattgaaaaaaagtcttttgttgattcaattatttttatagtgtgtttggaagcccgtttgagaaaataagaaatcgcatctggaatgtgaaagttataactatttagcttcatttgtcgttgcaagttctttattggttaaatttttatagcgtgctaggaaacccattcgagaaaaataagaaatcacatctggaatgtgaaagttataactgttagcttctgagtaaacgtgaaaaaccacattttgggatttggaaccaaaatttatttgataaattgacaaccaaattgattttgatgga

SEQ ID NO: 3453 - DNA, 666 bp, Artificial
  Glycine max FAD3B mutation created with TALEN pair GmFAD3_T02.1
ctcacacattgttctgttatgtcatttcttcttcatttggctttagacaacttaaattttgagatctttattatgttttttgcttatatggtaaagtgattcttcattatttcattcttcattgattgaattgaacagtggccatggaagctttttcagatagccccttttgctgaatagcctgggtggggacacattcctcaattcttgtgccataccatggatggttagttcatactggcttttttgtttgttcatttgtcattgaaaaaaaagtcttttgttgattcaattatttttatagtgtgtttggaagcccgtttgagaaaaattaagaaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttgatttgataaatgacaaccaaattgattttgatggattttgcaggagaattagccacagaactcaccatcaaaaagccatggacacattgagaaggatgagtcatgggttccagtatgtgattaattgc

SEQ ID NO: 3454 - DNA, 792 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttgcattcttcattgctgcgcatcaccagtggattggtttagttcatactggctttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaaagggaatctttatgcttcctgaggctgttcttgaacatggctcttttttatgtgtcattatcttagttaa

SEQ ID NO: 3455 - DNA, 787 bp, Artificial
  Glycine max FAD3B mutation created with TALEN pair GmFAD3_T02.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacactgcattgcctccattcattgttgcgcataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggaatctttatgcttcctgaggctgttcttgaacatggctcttttttatgtgtcattatcttagttaa

SEQ ID NO: 3456 - DNA, 779 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtcccaaagaaaaaaagggtaatctttatgcattcctgaggctgttcttgaacatggctcttttttatgtgtca

SEQ ID NO: 3457 - DNA, 779 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacactgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacatttttatttatttggtagggtccaagaaaaagggaatctttatgcattcctgaggtctgttcttgaacatggctcttttttatgtgtcattatc

SEQ ID NO: 3458 - DNA, 685 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttgtatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattaca

SEQ ID NO: 3459 - DNA, 785 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaagggtaatctttatgcattcctgaggctgttcttgaacatggctcttttttatgtgtcattatcttagttaa

SEQ ID NO: 3460 - DNA, 789 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacagcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtcccaagaaaaaagggtaatctttatgcattcctgaggctgttcttgaacatggctcttttttatgtgtcatttatcttagttaa

SEQ ID NO: 3461 - DNA, 789 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacagcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaaagggtaatctttatgcattcctgaggtctgttcttgaacatggctcttttttatgtgtcatttatcttagttaa

SEQ ID NO: 3462 - DNA, 767 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgcattcctcaattcttgtgccataccatggatggttagttcatactggcttttttgtttgttcatttgtcattgaaaaaaatcttttgttgattcaattattttaatagtgtgtttggaagcccgttttgagaaaattaagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtcccaaagaaaaaaagggtaatctttatgcattcctgaggtctgtcttgaacatggctcttttttatgtgtcattatcttagttaa

SEQ ID NO: 3463 - DNA, 785 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtggggacacgcattgcctcattcattgttgcgcataccatggatggttagttcatactggcttttttgtttgttcatttgtcattgaaaaaaaagtcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaaccaaattttattttgataaaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaaaagggaatctttatgcttcctgaggctgttcttgaacatggctcttttttaatgtgtcattta

SEQ ID NO: 3464 - DNA, 707 bp, Artificial
  Glycine max FAD3B mutation created with TALEN pair GmFAD3_T02.1
  misc_feature (296): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacactgtcattgccttccattcattgttgcgcataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggta

SEQ ID NO: 3465 - DNA, 765 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacactgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacatttttatttatttggtagggtccaagaaaaagggaatctttatgcattcctgaggctgttcttgaacatggctctttttt

SEQ ID NO: 3466 - DNA, 733 bp, Artificial
  Glycine max FAD3B mutation created with TALEN pair GmFAD3_T02.1
  misc_feature (685): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacgcattcctcaattcttgtgccataccatggatggttagttcatactggcttttttgtttgttcatttgtcattgaaaaaaaatcttttgttgattcaattatttttatagtgtgtttggaagcccgtttgagaaaaattaagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacnttttatttatttggtagggtccaagaaaaaaatgggaatcttttatgc

SEQ ID NO: 3467 - DNA, 790 bp, Artificial
  Glycine max FAD3B mutation created with TALEN pair GmFAD3_T02.1
  misc_feature (296): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacatcctcaattctttgtcgtccatcaatcctgatggcatgctagttcgatgtgtctggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggaatctttatgcattcctgaggctgttcttgaacatggctcttttttatgtgtcattatcttagttaa

SEQ ID NO: 3468 - DNA, 700 bp, Artificial
  Glycine max FAD3B mutation created with TALEN pair GmFAD3_T02.1
ctcacacattgttctgttatgtcatttcttcttcatttggctttagacaacttaaatttatgagatctttattatgtttttgcttatatggtaaagtgattcttcattatttcattcttcattgattgaattgaacagtggccatggaagcttttcagatagccctttgctgaatagcctggtgggacacagcattcctcaattcttgtgccataccatggatggttagttcatactggcttttttgtttgttcatttgtcattgaaaaaaaagtcttttgttgattcaattatttttatagtgtgtttggaagcccgtttgagaaaaattaagaaaatcgcatctggaatgtgaaaagttataactatttagcttcatttgtcgttgcaagttcttttattggtaaatttttatagcgtgctaggaaacccattcgagaaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttattta

SEQ ID NO: 3469 - DNA, 782 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacatttttatttatttggtagggtcccaagaaaaaagggaatctttatgcattcctgaggctgttcttgaacatggctcttttttatgtgtcattatcttagttaa

SEQ ID NO: 3470 - DNA, 689 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgcattcctcaattcttgtgccataccatggatggttagttcatactggcttttttgtttgttcatttgtcattgaaaaaaaagtcttttgttgattcaattatttttatagtgtgtttggaagcccgtttgagaaaaattaagaaaatcgcatctggaatgtgaaaagttataactatttagcttcatttgtcgttgcaagttcttttattggttaaatttttatagcgtgctaggaaacccattcgagaaaaagtaagaaattcacatctggaatgtgaaagttataactgttagcttctgagtaaacgtggaaaaatccacattttggatttggaaccaaaattttgatttgataaatgacaaccaaattgattttgatggattttgcaggagaattagccacagaactcaccatcaaaaagccatggacacattgagaaggatgagtcatgggttccagtatgtgattaattgcttctcctatagttgttcttgattcaattaca

SEQ ID NO: 3471 - DNA, 775 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggatgcattcctcaattcttgtgccataccatggatggttagttcatactggctttttttgtttgttcatttgtcattgaaaaaaaatcttttgttgattcaattatttttatagtgtgtttggaagcccgtttgagaaaaattaagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtcccaagaaaaaagggtaatctttatgcattcctgaggtctgttcttgaacatggctcttttttatgtgtca

SEQ ID NO: 3472 - DNA, 785 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatgcattcctcaattcttgtgccataccatggatggttagttcatactggcttttttgtttgttcatttgtcattgaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaagggaatctttatgcttcctgaggctgttcttgaacatggctcttttttatgtgtcattatcttagttaa

SEQ ID NO: 3473 - DNA, 787 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacattcctcaattcttgtgccataccatggatggttagttcatactggcttttttgtttgttcatttgtcattgaaaaaaaatcttttgttgattcaattatttttatagtagtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaaccacattttggatttggaaccaaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacatttttatttatttggtagggtccaagaaaaaagggtaatctttatgcattcctgaggtctgttcttgaacatggctcttttttatgtgtcattatcttagttaa

SEQ ID NO: 3474 - DNA, 772 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacactgcattcctcaattcttgtgccataccatggatggttagttcatactggcttttttgtttgttcatttgtcattgaaaaaaaagtcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaagccatggacacattgagaaggatgagtcatgggttccagtatgtgattaattgcttctcctatagttgttcttgattcaattacattttatttatttggtagggtcccaagaaaaaaatgggaatcttttatgcttcctgaggctgttcttgaacatggctcttttttt

SEQ ID NO: 3475 - DNA, 486 bp, Artificial
  Glycine max FAD3B mutation created with TALEN pair GmFAD3_T02.1
  misc_feature (263): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaattcttgtgccataccatggatggttagttcatactggcttttttgtttgttcatttgtcattgaaaaaaaactcttttgttgattcaattntttttatagtgtgtttggaagcccgtttgagaaaattaagaaatcgcatctggaatgtgaaagttataactatttagcttcatttgtcgttgcaagttcttttattggttaaaatttttgatagcgtgctaggaaacccattcgagaaaattaagaaaattcacatctggaatgtgaaacgttataactgttagcttctgagtaaacgtggaaaaaatccaca

SEQ ID NO: 3476 - DNA, 779 bp, Artificial
  Glycine max FAD3B mutation created with TALEN pair GmFAD3_T02.1
ctcacacattgttctgttatgtcatttcttcttcatttggctttagacaacttaaatttgagatctttattatgttttttgcttatatggtaaagtgattcttcattatttcattcttcattgattgaattgaacagtggccatggaagcttttcagatagccctttgctgaatagcctggtggggacattgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgtaggagaattagccacagaactcaccatcaaaaccatggacacattgagaaggatgagtcatgggttccagtatgtgattaattgcttctcctatagttgttcttgattcaattacattttatttatttggtagggtccaagaaaaaatgggaatctttatgcttcctgaggctgttcttgaacatggctcttttttatgtgtcatatc

SEQ ID NO: 3477 - DNA, 703 bp, Artificial
  Glycine max FAD3B mutation created with TALEN pair GmFAD3_T02.1
ctcacacattgttctgttatgtcatttcttcttcatttggctttagacaacttaaatttgagatctttattatgttttttgcttatatggtaaagtgattcttcattatttcattcttcattgattgaattgaacagtggccatggaagcttttcagaagccctttgctgaatagcctggtgggacagcattcctcaattcttgtgccataccatggatggttagttcatactggcttttttgtttgttcatttgtcattgaaaaaaaagtcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaatccacattttggatttggaaccaaattttgatttgataaatgacaaccaaattgattttgatggattttgcaggagaattagccacagaactcaccatcaaaagccatggacacattgagaaggatgagtcatgggttccagtatgtgattaattgcttctcctatagttgttcttgattcaattacattttatttatttggta

SEQ ID NO: 3478 - DNA, 753 bp, Artificial
  Glycine max FAD3B mutation created with TALEN pair GmFAD3_T02.1
  misc_feature (508); (718): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacagcgcctgcttgccaccgccattgctggcgatggccaccacctgctggggggtcaagccgtgggcctggcacagcaccggcaacagccgctggaccgtcttgcattcctcaattcttgtgccataccatggatggttagttcatactggctttttgtttgttcatttgtcattgaaaaaaatcttttgttgattcaattatttttatagtgtgtttggaagcccgtttgagaaaataagaaatcgcatctggaatgtgaaagttataactatttagcttcatttgtcgttgcaagttcttttattggttaaaatttttanagcgtgctaggaaacccattcgagaaaataagaaatcacatctggaatgtgaaagttataactgttagcttctgagtaaacgtgggaaaaaaccacattttggatttggaaccaaatttttatttgataaatgacaaccaaattgattttgatggaatttttgtcaggaggaattagccacagaactcaccatcaaaaccatggacactnattgagaaggatgagtcatgggttccagtatgtga

SEQ ID NO: 3479 - DNA, 778 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacagcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaatgggaatctttatgcttcctgaggctgttcttgaacaggctctttttttatgtgcatttatcttta

SEQ ID NO: 3480 - DNA, 705 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttcttgcattcctcaattcttgtgccataccatggatggttagttcatactggcttttttgtttgttcatttgtcattgaaaaaaaactcttttgttgatttcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaaccacattttggatttgggaaccaaattttatttgataaatgacaaccaaattgatttgatggattttgcaggagaattagccacagaatctcaccatcaaaaccatggacacattgagaggatgagtcatggttccagtatgtgattaattgcttctcctatagttgttcttgattcaattacatttttattta

SEQ ID NO: 3481 - DNA, 789 bp, Artificial; identical to SEQ ID NO: 3333
  Glycine max FAD3B mutation created with TALEN pair GmFAD3_T02.1
  misc_feature (296): n is a or c or t or g

SEQ ID NO: 3482 - DNA, 775 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacattcctcaattcttgtgccataccatggatggttagttcatactggctttttttgtttgttcatttgtcattgaaaaaaaatcttttgttgattcaattatttttatagtgtgtttggaagcccgtttgagaaaaattaagaaatcgcatctggaatgtgaaaagttataactatttagcttcatttgtcgttgcaagtttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacatgaactcatccatcaaaaccatggacacattgagaaggatgagtcatgggttccagtatgtgattaattgcttctcctatagttgttcttgattcaaattacattttatttatttgggtagggtccaagaaaaagggaatctttatgcattcctgaggctgttcttgaacatggctcttttttatgtgtca

SEQ ID NO: 3483 - DNA, 732 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacagcattcctcaattcttgtgccataccatggatggttagttcatactggcttttttgtttgttcatttgtcattgaaaaaaaagtcttttgttgattcaattatttttatagtgtgtttggaagcccgtttgagaaaaattaagaaaatcgcatctggaatgtgaaaagttataactatttagcttcatttgtcgttgcaagttcttttattggttaaatttttatagcgtgctaggaaacccattcgagaaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacatttttatttatttggtagggtcccaagaaaaaaatgggaatc

SEQ ID NO: 3484 - DNA, 786 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaaacccattcgagaaaaataagaaatcacatctggaatgtgaaagttataactgttagcttctgagtaaacgtggaaaaaccacattttggatttggaaccaaaattttatttgataaatgacaaccaaattgattttgatggattttgcaggagaattagccacagaactcaccatcaaaaccatggacacattgagaaaggatgagtcatgggttccagtatgtgattaattgcttctcctatagttgttcttgattcaattacattttatttatttggtaggtccaagaaaaaagggtaatctttatgcattcctgaggtctgttcttgaacatggctcttttttatgtgtcattatcttagttaa

SEQ ID NO: 3485 - DNA, 783 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggatgcattcctcaattcttgtgccataccatggatggttagttcatactggctttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggtaatctttatgcattcctgaggctgttcttgaacatggctcttttttatgtgtcattatcttagttaa

SEQ ID NO: 3486 - DNA, 704 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggtgcattcctcaattcttgtgccataccatggatggttagttcatactggcttttttgtttgttcatttgtcattgaaaaaaaagtcttttgttgattcaattatttttatagtgtgtttggaagcccgtttgagaaaaataagaaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaatccacattttggatttggaaccaaaattttgatttgataaatgacaaccaaattgattttgatggattttgcaggagaattagccacagaactcaccatcaaaagccatggacacattgagaaggatgagtcatgggttccagtatgtgattaattgcttctcctatagttgttcttgattcaattacattttatttatttggta

SEQ ID NO: 3487 - DNA, 790 bp, Artificial
  Glycine max FAD3B mutation created with TALEN pair GmFAD3_T02.1
  misc_feature (297): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacatcctcaattctttgtcgtccatcaattcctgatggcatgctagttcgatgtgtctggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggaatctttatgcttcctgaggctgttcttgaacatggctcttttttatgtgtcattatcttagttaa

SEQ ID NO: 3488 - DNA, 793 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacaaaaattaaagaaatcatagagtctagcatagtgtttggagtgaaattcttgtgccataccatggatggttagttcatactggctttttttgttgttcatttgtcattgaaaaaaaatcttttgttgattcaattatttttatagtgtgtttggaagccgtttgagaaaataagaaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaaatgacaaccaaattgattttgatggattttgcaggagaattagccaacagaactcaccattcaaaaccattggacacaattgagaaggatgagtcatgggttccagtatgtgaattaattgcttctcctatagttgttcttggattcaattacattttatttatttgggtaggtccaagaaaaaagggtaatcttttatgcttcctgaggctgttcttgaaa

SEQ ID NO: 3489 - DNA, 788 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggataagtgtattctttcattatttcattcttcattgattgaattgaacagctggccatggaagctttttcagatagccctttgctgaatagcctggtgggacacagcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacatgaactcaccatcaaaaccatggacacattgagaaggatgagtcatgggttccagtatgtgattaattgcttctcctatagttgttcttgattcaattacattttatttatttggtaggtccaagaaaaagggaatctttatgcttcctgaggctgttcttgaacatggctcttttttatgtgtcattatcttagttaa

SEQ ID NO: 3490 - DNA, 779 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacactgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaaatttttatagcgtgctaggaaaacccattcgagaaaaataagaaatcacatctggaatgtgaaagttataactgttagcttctgagtaaaacgtggaaaaaaaccacattttggatttggaaccaaaaattttatttgataaaatgacaaaccaaaattgattttgatggattttgcaggagaaattagccacagaactcaccatcaaaaaccatggacacattgagaaaggatgagtcatgggttccagtatgtgattaattgcttctcctatagttgttcttgattcaattacattttatttatttggtaggtccaagaaaaaagggaatctttatgcattcctgaggctgttcttgaacatggctctttttt

SEQ ID NO: 3491 - DNA, 786 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtcccaagaaaaaaatgggtaatcttttatgctttcctgaggctgtttcttgaacatggctcttttttatgtgcattatcttagttaa

SEQ ID NO: 3492 - DNA, 818 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacagcaggcgctggagacggtgctgtgccaggcccacggcttgaccccggagcaggtggtggccatcgccagccacgatggcggcaagcaggccattcctcaattcttgtgccataccatggatggttagttcatactggcttttttgtttgttcatttgtcattgaaaaaaaatcttttgttgattcaattatttttatagtgtgtttggaagcccgtttgagaaaataagaaatcgcatctggaatgtgaaagttataactatttagcttcatttgtcgttgcaagttcttttattggttaaatttttatagcgtgctaggaaacccattcgagaaaaataagaaatcacatctggaatgtgaaagttataactgttagcttctgagtaaacgtggaaaaaccacattttgggatttggaaccaaatttatttgataaatgacaaccaaattgattttgatggatttgcaggaagaattagccacagaatctcaccatcaaaaccatggacacattgagaaggatgagtcatgggttccagtatgtgattaattgcttctcctatagttgttcttgattcaattacattttatttatttggtaggtccaagaaaaagggaatctttatgc

SEQ ID NO: 3493 - DNA, 769 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatttgcattcctcaattcttgtgccataccatggatggttagttcatactggcttttttgtttgttcatttgtcattgaaaaaaaactcttttgttgattcaattatttttatagtgtgtttggaagcccgtttgagaaaattaagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggaatctttatgcattcctgaggtctgttcttgaacatggctcttttttatgtgtcatttatcttag

SEQ ID NO: 3494 - DNA, 790 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtggggacattgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaagggtaatctttatgcattcctgaggctgttcttgaacatggctcttttttatgtgtcatttatcttagttaa

SEQ ID NO: 3495 - DNA, 778 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtggggacattgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgtaggagaattagccacagaactcaccatcaaaaccatggacacattgagaaggatgagtcatgggttccagtatgtgattaattgcttctcctatagttgttcttgattcaattacattttatttatttggtagggtccaagaaaaaaagggtaatcttttaatgcttcctgaggtctgttcttgaacatggctcttttttatgtgtca

SEQ ID NO: 3496 - DNA, 786 bp, Artificial
  Glycine max FAD3B mutation created with TALEN pair GmFAD3_T02.1
  misc_feature (296): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacactgtcattgccttccattcattgttgcgcataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaatgggaatctttatgcttcctgaggctgttcttgaacatgggctcttttttatgtgtcattatctag

SEQ ID NO: 3497 - DNA, 788 bp, Artificial
  Glycine max FAD3B mutation created with TALEN pair GmFAD3_T02.1
  misc_feature (295): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacactgcattgccttccattcattgttgcgcataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggaatctttatgcttcctgaggctgttcttgaacatggctcttttttatgtgtcattatcttagttaa

SEQ ID NO: 3498 - DNA, 780 bp, Artificial
  Glycine max FAD3B mutation created with TALEN pair GmFAD3_T02.1
ctcaattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggaatctttatgcttcctgaggctgttcttgaacatggctcttttttatgtgcattatcttagttaa

SEQ ID NO: 3499 - DNA, 749 bp, Artificial
  Glycine max FAD3B mutation created with TALEN pair GmFAD3_T02.1
  misc_feature (299): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtggggacacgtcatttgccattccattcattgcttgcgcataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggaatctttatgcttcctgaggctg

SEQ ID NO: 3500 - DNA, 772 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggaagcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtcccaagaaaaaagggtaatctttatgcattcctgaggctgttcttgaacatggctcttttttatgtgtca

SEQ ID NO: 3501 - DNA, 793 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggtagcatcctcaattctttgtcagtccatcaatcctgatggcatagctagttcgatgtgtctacggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaatgggaatcttttatgcttcctgaggctgttcttgaacatggctcttttttatgtgcattatcttag

SEQ ID NO: 3502 - DNA, 480 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttcctcaattcttgtgccataccatggatggttagttcatactggcttttttgtttgttcatttgtcattgaaaaaaaactcttttgttgattcaattatttttatagtgtgtttggaagcccgtttgagaaaattaagaaatcgcatctggaatgtgaaagttataactatttagcttcatttgtcgttgcaagttcttttattggttaaaatttttatagcgtgctaggaaaacccattcgagaaaataagaaatcacatctggaatgtgaaagttataactgttagcttctgagtaaacgtggaaaaaccaca

SEQ ID NO: 3503 - DNA, 788 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaagggaatcttttatgcattcctgaggctgttcttgaacatggctcttttttatgtgtcatttatcttagttaa

SEQ ID NO: 3504 - DNA, 784 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtggggacattgcattcctcaattcttgtgccataccatggatggttagttcatactggctttttttgtttgttcatttgtcattgaaaaaaaatcttttgttgattcaattatttttatagtgtgtttggaagcccgtttgagaaaaattaagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaagccatggacacattgagaaggatgagtcatgggttccagtatgtgattaattgcttctcctatagttgttcttgattcaattacattttatttatttggtagggtccaagaaaaagggaatctttatgcttcctgaggctgttcttgaacatggctcttttttatgtgtcattatcttag

SEQ ID NO: 3505 - DNA, 685 bp, Artificial
  Glycine max FAD3B mutation created with TALEN pair GmFAD3_T02.1
  misc_feature (295): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacactgcattgccttccattcattgttgcgcataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaaccatggacacattgagaaggatgagtcatgggttccagtatgtgattaattgcttctcctatagttgttcttgattc

SEQ ID NO: 3506 - DNA, 760 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacactcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaagggtaatctttatgcattcctgaggctgttcttgaacatggctctttttt

SEQ ID NO: 3507 - DNA, 720 bp, Artificial
  Glycine max FAD3B mutation created with TALEN pair GmFAD3_T02.1
  misc_feature (295): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacactgcattgccttccattcattgttgcgcataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaa

SEQ ID NO: 3508 - DNA, 699 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacgcattcctcaattcttgtgccataccatggatggttagttcatactggcttttttgtttgttcatttgtcattgaaaaaaaagtcttttgttgattcaattatttttatagtgtgtttggaagcccgtttgagaaaaattaagaaaatcgcatctggaatgtgaaaagttataactatttagcttcatttgtcgttgcaagttcttttattggttaaaatttttatagcgtgctaggaaacccattcgagaaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttattta

SEQ ID NO: 3509 - DNA, 780 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacagcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaaatttttatagcgtgctaggaaaacccattcgagaaaaataagaaatcacatctggaatgtgaaagttataactgttagcttctgagtaaacgtggaaaaaaccacattttggatttggaaccaaaattttatttgataaatgacaaccaaattgattttgatggattttgcaggagaattagccacagaactcaccatcaaaaaccatggacacattgagaaggatgagtcatgggttccagtatgtgattaattgcttctcctatagttgttcttgattcaaattacattttatttatttggtagggtccaaagaaaaaagggaatctttatgcattcctgaggctgttcttgaacatggctcttttttatgtgtca

SEQ ID NO: 3510 - DNA, 776 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaaacccattcgagaaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaagggtaatctttatgcattcctgaggtctgttcttgaacatggctcttttttaatgtgtca

SEQ ID NO: 3511 - DNA, 774 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacagcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaaagggaatcttttatgcattcctgaggctgttcttgaacatggctcttttttatgtgtca

SEQ ID NO: 3512 - DNA, 769 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaagggtaatctttatgcattcctgaggtctgttcttgaacatggctcttttttatgtgtca

SEQ ID NO: 3513 - DNA, 779 bp, Artificial
  Glycine max FAD3B mutation created with TALEN pair GmFAD3_T02.1
  misc_feature (292): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacactgcattgctccatcattgttgcgcataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaagggaatctttatgcttcctgaggctgttcttgaacatggctcttttttatgtgtcatttatc

SEQ ID NO: 3514 - DNA, 743 bp, Artificial
  Glycine max FAD3B mutation created with TALEN pair GmFAD3_T02.1
ctcacacattgttctgttatgtcatttcttcttcatttggctttagacaacttaaatttgagatctttattatgttttttgcttatatggtaaagtgattcttcattatttcattcttcattgattgaattgaacagtggccatggaagcttttcagatagccctttgctgaatagcctggtgggaccgcattcctcaattcttgtgccataccatggatggttagttcatactggcttttttgtttgttcatttgtcattgaaaaaaaagtcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaagccatggacacattgagaaggatgagtcatgggttccagtatgtgattaattgcttctcctatagttgttcttgattcaattacattttatttatttggtagggtccaagaaaaatgggaatctttatgcttcctgaggct

SEQ ID NO: 3515 - DNA, 794 bp, Artificial
  Glycine max FAD3B mutation created with TALEN pair GmFAD3_T02.1
  misc_feature (298): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtggggacacgcattgccattccattcattgcttgtcgcataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaaagggaatctttatgcattcctgaggctgttcttgaacatggctcttttttatgtgtcatttatctagttaa

SEQ ID NO: 3516 - DNA, 778 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaaattacatttttattttatttgggtagggttcccaaagaaaaaaagggtaatcttttatgcattcctgaggtctgttcttgaacatggctcttttttatgtgtca

SEQ ID NO: 3517 - DNA, 772 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagccttcctcaattcttgtgccataccatggatggttagttcatactggcttttttgtttgttcatttgtcattgaaaaaaaactcttttgttgattcaattatttttatagtgtgtttggaagcccgtttgagaaaataagaaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtgaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaaaggggaatctttatgcttcctgaggctgttcttgaacatggctcttttttatgtgtcattatcttagttaa

SEQ ID NO: 3518 - DNA, 785 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtggggcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacatgaactcaccatcaaaaccatggacacattgagaaggatgagtcatgggttccagtatgtgattaattgcttctcctatagttgttcttgattcaattacattttatttatttggtagggttcccaatgaaaaaaagggtaaaatcttttatgcttcctgaggctgttcttgaacatggctcttttttatgtgcattatcttag

SEQ ID NO: 3519 - DNA, 769 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacttcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaaagggtaatctttatgcattcctgaggtctgttcttgaacatggctcttttttatgtgtca

SEQ ID NO: 3520 - DNA, 789 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggataagtgtattctttcattatttcattcttcattgattgaattgaacagctggccatggaagcttttcagatagccctttgctgaatagcctggtgggacacagcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacatgaactcaccatcaaaaccatggacacattgagaaggatgagtcatgggttccagtatgtgattaattgcttctcctatagttgttcttgattcaattacattttatttatttggtaggtccaagaaaaagggaatctttatgcttcctgaggtctgttcttgaacatggctcttttttatgtgtcatttatcttagttaa

SEQ ID NO: 3521 - DNA, 719 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtcccaagaaaaaaa

SEQ ID NO: 3522 - DNA, 684 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattaca

SEQ ID NO: 3523 - DNA, 677 bp, Artificial; identical to SEQ ID NO: 3257
  Glycine max FAD3B mutation created with TALEN pair GmFAD3_T02.1

SEQ ID NO: 3524 - DNA, 623 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggaaatcgcatctggaatgtgaaagttataactatttagcttcatttgtcgttgcaagttcttttattggttaaatttttatagcgtgctaggaaacccattcgagaaaataagaaatcacatctggaatgtgaaaagttataactgttagcttctgagtaaacgtggaaaaaccacattttggatttggaaccaaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttattttatttggtaggtccaagaaaaaaagggaatctttatgcttcctgaggctgttcttgaacatggctctttttatgtgtc

SEQ ID NO: 3525 - DNA, 766 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacattgcattcctcaattcttgtgccataccatggatggttagttcatactggcttttttgtttgttcatttgtcattgaaaaaaaagtcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaaatgggaatctttatgcttcctgaggctgttcttgaacatggctctttttt

SEQ ID NO: 3526 - DNA, 697 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacgcattcctcaattcttgtgccataccatggatggttagttcatactggcttttttgtttgttcatttgtcattgaaaaaaaagtcttttgttgattcaattatttttatagtgtgtttggaagcccgtttgagaaaaattaagaaaatcgcatctggaatgtgaaaagttataactatttagcttcatttgtcgttgcaagttcttttattggttaaaatttttatagcgtgctaggaaacccattcgagaaaaagtaagaaattcacatctggaatgtgaaagttataactgttagcttctgagtaaacgtggaaaaaaccacattttggatttggaaccaaaattttgattttgataaaatgacaaccaaaattgatttttgatggattttgcaggagaattagccacagaactcaccatcaaaaaccatggacacattgagaaggatgagtcatgggttccagtatgtgattaattgcttctcctatagttgttcttgattcaatt

SEQ ID NO: 3527 - DNA, 862 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacactttgaatttaaagctaatttggttcaaaacaaagcctaaagttaattaaatgtcaaataaacatcacaaaatgcacttgcattcctcaattcttgtgccataccatggatggttagttcatactggcttttttgtttgttcatttgtcattgaaaaaaaattcttttgttgattcaattatttttatagtgtgtttggaagcccgttttgagaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttgggatttggaaccaaaatttatttgataaattgacaaccaaattgattttgatggattttgcaggagaattagccacagaatctcaccatcaaaatccatggacacattgagaaggatgagtcatgggttccagtatgtgatttaattgcttctcctatagttgttcttgattcaattacattttatttatttggtaggtccaagaaaaagggaatctttatgcttcctgaggctgttcttgaacatggctcttttttatgtgtcattatcttag

SEQ ID NO: 3528 - DNA, 789 bp, Artificial; identical to SEQ ID NO: 3333
  Glycine max FAD3B mutation created with TALEN pair GmFAD3_T02.1
  misc_feature (296): n is a or c or t or g

SEQ ID NO: 3529 - DNA, 767 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacataccatggatggttagttcatactggcttttttgtttgttcatttgtcattgaaaaaaatcttttgttgattcaattatttttatagtgtgtttggaagcccgtttgagaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttatttgataaatgacaaccaaaattgattttgatggattttgcaggagaattagccacagaactcaccatcaaaaaccatggacacattgagaaaggatgagtcatgggttccagtatgtgattaattgcttctcctatagttgttcttgattcaattacattttatttatttggtagggtccaagaaaaaagggaatcttttaatgcattcctgaggtctgttcttgaacatggctcttttttatgtgtcattatcttagttaa

SEQ ID NO: 3530 - DNA, 790 bp, Artificial
  Glycine max FAD3B mutation created with TALEN pair GmFAD3_T02.1
  misc_feature (299): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtggggacacgtcatttgccattccattcattgcttgcgcataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaaagggaatcttttatgcttcctgaggctgttcttgaacatggctcttttttatgtgcattatcttag

SEQ ID NO: 3531 - DNA, 771 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacgcattcctcaattcttgtgccataccatggatggttagttcatactggcttttttgtttgttcatttgtcattgaaaaaaagtcttttgttgattcaattatttttatagtgtgtttggaagcccgtttgagaaaaattaagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaagccatggacacattgagaaggatgagtcatgggttccagtatgtgattaattgcttctcctatagttgttcttgattcaattacattttatttatttggtagggtccaagaaaaagggaatctttatgcttcctgaggctgttctgaacatggctcttttttaatgtgc

SEQ ID NO: 3532 - DNA, 708 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttcctcaattcttgtgccataccatggatggttagttcatactggcttttttgtttgttcatttgtcattgaaaaaaaagtcttttgttgattcaattatttttatagtgtgtttggaagcccgtttgagaaaaataagaaatcgcatctggaatgtgaaaagttataactatttagcttcatttgtcgttgcaagttcttttattggttaaaatttttatagcgtgctaggaaacccattcgagaaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggt

SEQ ID NO: 3533 - DNA, 706 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggt

SEQ ID NO: 3534 - DNA, 550 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtattgcattcctcaattcttgtgccataccatggatggttagttcatactggcttttttgtttgttcatttgtcattgaaaaaaagtcttttgttgattcaattattttatagtgtgtttggaagcccgttgagaaaataagaatcgcatctggaatgtgaaagttataactatttagcttcatttgtcgttgcaagttc

SEQ ID NO: 3535 - DNA, 684 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtggggacacattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattaca

SEQ ID NO: 3536 - DNA, 779 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgcattcctcaattcttgtgccataccatggatggttagttcatactggcttttttgtttgttcatttgtcatcgaaaaaaatcttttgttgattcaattatttttaatagtgtgtttggaagcccgtttgagaaaattaagaaatcgcatctggaatgtgaaagttataactatttagcttcatttgtcgttgcaagttcttttattggttaaatttttatagcgtgctaggaaaacccattcgagaaaaataagaaatcacatctggaatgtgaaagttataactgttagcttctgagtaaacgtggaaaaaccacattttggatttggaaccaaaattttatttgataaatgacaaccaaattgattttgatggattttgcaggagaaattagccacagaactcaccatcaaaaccatggacacattgagaaaggatgagtcatgggttccagtatgtgattaattgcttctcctatagttgttcttgattcaaattacatttttattttattttgggtagggtcccaaagaaaaaaaagggaatcttttatgcattcctgaggtctgttcttgaacatggctcttttttatgtgtcattatcttagttaa

SEQ ID NO: 3537 - DNA, 767 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggcttggatcctcaattcttgtgtccatatcctatggcatgcttagttcgatgatgtctggctttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaagggaatctttatgcattcctgaggctgttcttgaacatggctctttttt

SEQ ID NO: 3538 - DNA, 688 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacactgcattcctcaattcttgtgccataccatggatggttagttcatactggcttttttgtttgttcatttgtcattgaaaaaaaagtcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaatccacattttggatttggaaccaaattttatttgataaatgacaaccaaattgattttgatggattttgcaggagaattagccacagaactcaccatcaaaagccatggacacattgagaaggatgagtcatgggttccagtatgtgattaattgcttctcctatagttgttcttgattcaattaca

SEQ ID NO: 3539 - DNA, 709 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtggggacacgcattgccttccattcattgttgcgcataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggg

SEQ ID NO: 3540 - DNA, 773 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtggggacagcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggtaatctttatgcattcctgaggtctgttcttgaacatggctcttttttatgtgtca

SEQ ID NO: 3541 - DNA, 773 bp, Artificial
  Glycine max FAD3B mutation created with TALEN pair GmFAD3_T02.1
ctcacacattgttctgttatgtcatttcttcttcatttggctttagacaacttaaaatttgagatctttattatgttttttgcttatatggtaaagtgattcttcattatttcattcttcattgattgaattgaacagtggccatggaagcttttcagatagccctttgctgaatagcctggtgggacacttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtcccaagaaaaaaagggtaatctttatgcattcctgaggctgttcttgaacatggctctttttt

SEQ ID NO: 3542 - DNA, 772 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtcctcaattcttgtgccataccatggatggttagttcatactggcttttttgtttgttcatttgtcattgaaaaaaatcttttgttgattcaattatttttatagtgtgtttggaagcccgtttgagaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtcccaagaaaaaatgggtaatcttttatgcttcctgaggtctgttcttgaacatggctcttttttatgtgtcatatcttagtt

SEQ ID NO: 3543 - DNA, 772 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacagcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggtaattctttatgcagttcctgaggctgtttcttgaacaggctcttttttatgtgc

SEQ ID NO: 3544 - DNA, 762 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacataccatggatggttagttcatactggcttttttgtttgttcatttgtcattgaaaaaaatcttttgttgattcaattatttttatagtgtgtttggaagcccgtttgagaaaattaagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaagggaatctttatgcattcctgaggtctgttcttgaacatggctcttttttatgtgtcattatcttagttaa

SEQ ID NO: 3545 - DNA, 778 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacagcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattccaattacattttatttatttggtagggtccaagaaaaaagggtaatctttatgcattcctgaggtctgttcttgaacatggctcttttttatgtgtca

SEQ ID NO: 3546 - DNA, 679 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacctcaattcttgtgccataccatggatggttagttcatactggcttttttgtttgttcatttgtcattgaaaaaaaagtcttttgttgattcaattatttttatagtgtgtttggaagcccgtttgagaaaaattaagaaatcgcatctggaatgtgaaaagttataactatttagcttcatttgtcgttgcaagttcttttattggttaaatttttatagcgtgctaggaaacccattcgagaaaaagtaagaaattcacatctggaatgtgaaagttataactgttagcttctgagtaaacgtggaaaaatccacattttggatttggaaccaaaattttgattttgataaaatgacaaccaaattgattttggatggattttgcaggagaattagccacagaactcaccatcaaaagccatggacacattgagaaggatgagtcatgggttccagtatgtgattaattgcttctcctatagttgttctt

SEQ ID NO: 3547 - DNA, 788 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggtttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtcccaagaaaaaaagggtaatctttatgcattcctgaggctgttcttgaacatggctcttttttatgtgtcattatcttagttaa

SEQ ID NO: 3548 - DNA, 680 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtggggacattcctcaattcttgtgccataccatggatggttagttcatactggctttttttgtttgttcatttgtcattgaaaaaaaagtcttttgttgattcaattatttttatagtgtgtttggaagcccgttttgagaaaaattaagaaatcgcatctggaatgtgaaaagttataactatttagcttcatttgtcgttgcaagtttcttttattggttaaatttttatagcgtgctaggaaacccattcgagaaaataagaaatcacatctggaatgtgaaagtataactgttagcttctgagtaaacgtggaaaaaccacattttggatttggaaccaaattttatttgataaatgacaaccaaattgattttgatggattttgcaggagaattagccacagaactcatccatcaaaaccatggacacattgagaaggatgagtcatgggttccagtatgtgattaattgcttctcctatagttgttcttgattc

SEQ ID NO: 3549 - DNA, 714 bp, Artificial
  Glycine max FAD3B mutation created with TALEN pair GmFAD3_T02.1
ctcacacattgttctgttatgtcatttcttcttcatttggctttagacaacttaaatttgagatctttattatgttttttgcttatatggtaaagtgattcttcattatttcattcttcattgattgaattgaacagtggccatggaagcttttcagatagccctttgctgaatagcctggtggggacgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaa

SEQ ID NO: 3550 - DNA, 697 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggaccattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggta

SEQ ID NO: 3551 - DNA, 709 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattattgcattcctcaattcttgtgccataccatggatggttagttcatactggcttttttgtttgttcatttgtcattgaaaaaaatcttttgttgattcaattatttttatagtgtgtttggaagcccgtttgagaaaataagaaatcgcatctggaatgtgaaaagttataactatttagcttcatttgtcgttgcaagttcttttattggttaaaatttttatagcgtgctaggaaacccattcgagaaaataagaaatcacatctggaatgtgaaagttataactgttagcttctgagtaaacgtggaaaaaaccacattttggatttggaaccaaattttatttgataaatgacaaccaaattgattttgatggattttgcaggagaattagccaacagaacttcaccatcaaaaaccatggacaacattgagaaggatgagtcatgggttccagtatgtgattaattgcttctcctatagttgttcttgattcaattacattttatttatttggtaggtccaagaaaaaaaggggaatctttatgcttcctgaggctgttcttgaacatggctcttttttatgtgtcattatcttagtt

SEQ ID NO: 3552 - DNA, 698 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggatgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggta

SEQ ID NO: 3553 - DNA, 518 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggagcattcctcaattcttgtgccataccatggatggttagttcatactggctttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaacc

SEQ ID NO: 3554 - DNA, 761 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggaatctttatgcttcctgaggctgttcttgaacatggctctttttt

SEQ ID NO: 3555 - DNA, 773 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtggggacacatgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacatttttattttatttgggtagggtccaaagaaaaaaagggtaatctttatgcattcctgaggctgttcttgaacatggctctttttt

SEQ ID NO: 3556 - DNA, 727 bp, Artificial
  Glycine max FAD3B mutation created with TALEN pair GmFAD3_T02.1
ctcacacattgttctgttatgtcatttcttcttcatttggctttagacaacttaaatttgagatctttattatgttttttgcttatatggtaaagtgattcttcattatttcattcttcattgattgaattgaacagtggccatggaagcttttcagatagccctttgctgaatagcctggtggggacagcattcctcaattcttgtgccataccatggatggttagttcatactggcttttttgtttgttcatttgtcattgaaaaaaaagtcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaatccacattttggatttggaaccaaaattttgattttgataaatgacaaccaaattgattttgatggattttgcaggagaattagccacagaactcaccatcaaaagccatggacacattgagaaggatgagtcatgggttccagtatgtgattaattgcttctcctatagttgttcttgattcaattacattttatttatttggtaggtccaagaaaaatgggaa

SEQ ID NO: 3557 - DNA, 795 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtggggacacatcgcatttgccattccattcattgttgcgcataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtcccaagaaaaagggaatctttatgcttcctgaggctgttcttgaacatggctcttttttatgtgtcattatcttagttaa

SEQ ID NO: 3558 - DNA, 708 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacatgcattgccttccattcattgttgcgcataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggg

SEQ ID NO: 3559 - DNA, 769 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtcccaagaaaaaaagggtaatctttatgcattcctgaggtctgttcttgaacatggctcttttttatgtgtca

SEQ ID NO: 3560 - DNA, 756 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatttgcattcctcaattcttgtgccataccatggatggttagttcatactggcttttttgtttgttcatttgtcattgaaaaaaatcttttgttgttcaattatttttatagtgtgtttggaagcccgtttgagaaaattaagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggaatctttatgcattcctgaggtctgttcttgaacatggctcttttttatgtgtca

SEQ ID NO: 3561 - DNA, 686 bp, Artificial; identical to SEQ ID NO: 3311
  Glycine max FAD3B mutation created with TALEN pair GmFAD3_T02.1

SEQ ID NO: 3562 - DNA, 784 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacactgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaaagggaatctttatgcttcctgaggctgttcttgaacatggctcttttttatgtgtcattatcttagttaa

SEQ ID NO: 3563 - DNA, 765 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggtaatctttatgcattcctgaggctgttcttgaacatggctctttttt

SEQ ID NO: 3564 - DNA, 770 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtggggacgcattcctcaattcttgtgccataccatggatggttagttcatactggctttttttgtttgttcatttgtcattgaaaaaaaatcattttgttgattcaattatttttattagtgtgtttggaatgcccgctttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtcccaagaaaaaatgggaatctttatgcttcctgaggctgttcttgaacatggctctttttt

SEQ ID NO: 3565 - DNA, 690 bp, Artificial
  Glycine max FAD3B mutation created with TALEN pair GmFAD3_T02.1
ctcacacattgttctgttatgtcatttcttcttcatttggctttagacaacttaaatttgagatctttattatgttttttgcttatatggtaaagtgattcttcattatttcattcttcattgattgaattgaacagtggccatggaagcttttcagatagccccttttgctgaatagcctggtgggacattgcattcctcaattcttgtgccataccatggatggttagttcatactggctttttttgtttgttcatttgtcattgaaaaaaaatcttttgttgattcaattatttttatagtgtgtttggaagcccgtttgagaaaaattaagaaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccatcattttggatttggaaccaaattttgatttgataaatgacaaccaaagttgattttgatggattttgtaggagaattagccacagaactcaccatcaaaagccatggacacattgagaaggatgagtcatgggttccagtatgtgattaattgcttctcctatagttgtttcttgattc

SEQ ID NO: 3566 - DNA, 748 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtggatggttagttcatactggcttttttgtttgttcatttgtcattgaaaaaaatcttttgttgattcaattatttttatagtgtgtttggaagcccgtttgagaaaataagaaatcgcatctggaatgtgaaagttataactatttagcttcatttgtcgttgcaagttcttttattggttaaaatttttatagcgtgctaggaaaacccattcgagaaaataagaaatcacatctggaatgtgaaagttataactgttagcttctgagtaaacgtggaaaaaaccacatttttggatttggaaccaaattttatttgataaatgacaaccaaattgattttgatggattttgcaggagaaattagccacagaactcaccatcaaaaccatggacacattgagaaggatgagtcatgggttccagtaatgtgattaattgcttctcctatagttgttcttgattcaattacattttatttatttggtaggtccaagaaaaagggaatctttatgcttcctgaggctgttcttgaacatggctctttttatgtgtcattatcttagtt

SEQ ID NO: 3567 - DNA, 788 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggataagtgtattctttcattatttcattcttcattgattgaattgaacagctggccatggaagcttttcagatagccctttgctgaatagcctggtgggacacagcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaaggatgagtcatgggttccagtatgtgattaattgcttctcctatagttgttcttgattcaattacattttatttatttggtagggtccaagaaaaagggaatctttatgcttcctgaggctgttcttgaacatggctcttttttatgtgtcattatcttagttaa

SEQ ID NO: 3568 - DNA, 779 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggaagcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaaagggtaatctttatgcattcctgaggctgttcttgaacatggctcttttttatgtgtcatttatctt

SEQ ID NO: 3569 - DNA, 705 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggt

SEQ ID NO: 3570 - DNA, 705 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaaatcgcatctggaatgtgaaaagttataactatttagcttcatttgtcgttgcaagttcttttattggttaaatttttatagcgtgctaggaaaacccattcgagaaaaataagaaatcacatctggaatgtgaaagttataactgttagcttctgagtaaacgtggaaaaaccacattttggatttggaaccaaattttatttgataaatgacaaccaaattgattttgatggattttgcaggagaaattagccacagaactcaccatcaaaaccatggacacattgagaaaggatgagtcatgggttccagtatgtgattaattgcttctcctatagttgttcttgattcaattacattttatttatttggtagggtcc

SEQ ID NO: 3571 - DNA, 673 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggatgcattcctcaattcttgtgccataccatggatggttagttcatactggcttttttgtttgttcatttgtcattgaaaaaaaatcttttgttgattcaattatttttatagtgtgtttggaagcccgtttgagaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgatt

SEQ ID NO: 3572 - DNA, 552 bp, Artificial
  Glycine max FAD3B mutation created with TALEN pair GmFAD3_T02.1
  misc_feature (296): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggagcatcctcaattcttgtgtccataatcctatggcatggcttagttcgatgatgtctggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaacc

SEQ ID NO: 3573 - DNA, 485 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacaacggtccagcggctgttgccggtgctgtgccatggcccacggctttgaccccccagcaggtaggcattcctcaattcttgtgccataccatggattggttagttcatactggcttttttgttgttcatttgtcatgaaaaaatctttgtgattcaattatttttatagtgtagttttggaagcccgttttgagaaataagaatcgcatctggaatgtgaaagtataactatttagcttcatttgtcgttgcaagttcttttatttggttaaatttttatagcgtgctaggaaccca

SEQ ID NO: 3574 - DNA, 761 bp, Artificial
  Glycine max FAD3B mutation created with TALEN pair GmFAD3_T02.1
  misc_feature (298): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacactgtcattgccattccattcattgttgcgcataccatggatggttagttcatactggcttttttgtttgttcatttgtcattgaaaaaaaagtcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaaccaaattttattttgataaatgacaaccaaattgattttgatggattttgcaggagaattagccacagaactcaccatcaaaagccatggacacattgagaaggatgagtcatgggttccagtatgtgattaattgcttctcctatagttgttcttgattcaattacattttatttatttggtaggtccaagaaaaatgggaatctttatgcttcctgaggctgttcttgaac

SEQ ID NO: 3575 - DNA, 769 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaaagggaatctttatgcttcctgaggctgttcttgaacatggctcttttttatgtgcattatc

SEQ ID NO: 3576 - DNA, 755 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtggggacattgcattcctcaattcttgtgccataccatggatggttagttcatactggctttttttgtttgttcatttgtcattgaaaaaaaatcttttgttgattcaattatttttatagtgtgtttggaagcccgtttgagaaaaattaagaaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaagggaatctttagcttcctgaggctgttctttgaaca

SEQ ID NO: 3577 - DNA, 792 bp, Artificial
  Glycine max FAD3B mutation created with TALEN pair GmFAD3_T02.1
ctcacacattgttctgttatgtcatttcttcttcatttggctttagacaacttaaatttgagatctttattatgttttttgcttatatggtaaagtgattcttcattatttcattcttcattgattgaattgaacagtggccatggaagcttttcagatagccctttgctgaatagcctggtggggacattgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtcccaagaaaaaagggtaatctttatgcattcctgaggtctgttcttgaacatggctcttttttatgtgtcatttatcttagttaa

SEQ ID NO: 3578 - DNA, 778 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggattcctcaattcttgtgccataccatggatggttagttcatactggctttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaagccatggacacattgagaaggatgagtcatgggttccagtatgtgattaattgcttctcctatagttgttcttgattcaattacattttatttatttggtagggtccaagaaaaatgggtaatcttttatgcattcctgaggctgtttcttgaacatggctcttttttatgtgcattatctta

SEQ ID NO: 3579 - DNA, 941 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacaattccacacaacatacgagccggaagcataaagtgtaaagcctggggtgcctaatgagtgagctaactcacattaattgcgttgcgctcactgcccgctttccagtcgggaaaacctgtcgtgccagctgcattaatgaatcggccaacgcgcggggagaggcattcctcaattcttgtgccataccatggatggttagttcatactggctttttgtttgttcatttgtcattgaaaaaaatcttttgttgattcaattattttatagtgtgtttggaagcccgtttgagaaaataagaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacatttttggattttggaaccaaaatttttatttgataaatgacaaccaaattgatttttgatggatttttgcaggagaattagccacagaactcaccatcaaaatccatggacacattgagaagggatgagtccatgggttccaagtatgtgattaattgcttctcctatagttgttcttgattcaattacatttatttatttggtaggtccaagaaaaagggaatcttatgcttcctgagctgttcttgaacatggctctttttatgtgtcattatcttag

SEQ ID NO: 3580 - DNA, 790 bp, Artificial
  Glycine max FAD3B mutation created with TALEN pair GmFAD3_T02.1
  misc_feature (296): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggatgcatcctcaattcttgtgtccataatcctatggcatgctagttcgatgatgtctggctttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaaccatggacacattgagaaggatgagtcatgggttccagtatgtgattaattgcttctcctatagttgttcttgattcaattacattttatttatttggtaggtccaagaaaaagggaatctttatgcttcctgaggctgttcttgaacatggctcttttttatgtgtcattatcttagttaa

SEQ ID NO: 3581 - DNA, 802 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacatttttatttatttggtagggtcccaaatgaaaaaaaatggggtaaagttctttttaatggccatttccctgaggtctggtttcctttgaaacatggctctttttttatgtgtcatatcttag

SEQ ID NO: 3582 - DNA, 419 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacagcgcctgcttgccaccgccattgctggcgatggccaccacctgctgggggtcaagccgtgggcctggcacagcaccggcaacatgccgctggatccgtcttgcattcctcaattcttgttgccataccatggatggttagttcatactggctttttgtttgttcatttgtcattgaaaaaagtcttttgttgattcaattatttttatagtgtgtttggaagcccgtttg

SEQ ID NO: 3583 - DNA, 713 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcagcccagcttggagctggagacggtccagcggctgttgccggtgctgtgccaggcccacgattcttgtgccataccatggatggttagttcatactggcttttttgtttgttcatttgtcattgaaaaaaatcttttgttgattcaattattttatagtgtgtttggaagcccgtttgagaaaataagaaatcgcatctggaatgtgaaagttataactattagcttcatttgtcgttgcaagttcttttattggttaaatttttatagcgtgctaggaaacccttcgagaaaataagaaatcacatctggatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagtg

SEQ ID NO: 3584 - DNA, 788 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacattcctcaattcttgtgccataccatggatggttagttcatactggctttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtcccaagaaaaaaatgggtaattcttttaatgcatttcctgaggtctgtttcttgaacatggctcttttttatgtgtcatatcttag

SEQ ID NO: 3585 - DNA, 778 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtggggacacgcattgccattccattcattgcttgtcgcataccatggatggttagttcatactggcttttttgtttgttcatttgtcattgaaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaaacccattcgagaaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaaagaaaaaaagggaatctttatgcattcctgaggctgttcttgaacatggctctttttt

SEQ ID NO: 3586 - DNA, 771 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggtgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtcccaagaaaaaagggtaatctttatgcattcctgaggctgttcttgaacatggctcttttttatgtgtca

SEQ ID NO: 3587 - DNA, 717 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaattcttgtgccataccatggatggttagttcatactggcttttttgtttgttcatttgtcattgaaaaaaactcttttgttgattcaattatttttatagtgtgtttggaagcccgtttgagaaaataagaaatcgcatctggaatgtgaaagttatactatttagcttcatttgtcgttgcaagttcttttattggttaaaatttttatagcgtgctaggaaaacccattcgagaaaataagaaatcacatctggaatgtgaaagttataactgttagcttctgagtaaacgtggaaaaaccacatttttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacatttttattttatttgggtaggtccaagaaaaacgggaatctttatgcttcctgaggctg

SEQ ID NO: 3588 - DNA, 680 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcctcaattcttgtgccataccatggatggttagttcatactggcttttttgtttgttcatttgtcattgaaaaaaatcttttgttgattcaattatttttatagtgtgtttggaagcccgtttgagaaaataagaaatcgcatctggaatgtgaaagttataactatttagcttcatttgtcgttgcaagttcttttattggttaaaatttttatagcgtgctaggaaacccattcgagaaaaataagaaatcacatctggaatgtgaaagttataactgttagcttctgagtaaacgtggaaaaaaccacattttggatttggaaccaaattttatttgataaatgacaaccaaattgattttgatggattttgcaggagaattagccacagaacttcaccatcaaaaaccatggacacattgagaaggatgagtcatgggttccagtatgtgattaattgcttctcctatagttgttcttgattcaattacattttatttatttggtaggtccaagaaaaaaagggaatctttatgcttcctgaggctgttcttgaacatggct

SEQ ID NO: 3589 - DNA, 783 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtcccaagaaaaaaagggtaatctttatgcattcctgaggtctgttcttgaacatggctcttttttatgtgtcattatcttagttaa

SEQ ID NO: 3590 - DNA, 780 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattccaattacattttatttatttggtagggtccaagaaaaagggtaatctttatgcattcctgaggtctgttcttgaacatggctcttttttatgtgtcattatcttagttaa

SEQ ID NO: 3591 - DNA, 777 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggaagcattcctcaattcttgtgccataccatggatggttagttcatactggctttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttatttgataaatgacaaccaaattgattttgatggattttgtaggagaattagccacagaactcaccatcaaaaccatggacacattgagaaggatgagtcatgggttccagtatgtgattaattgcttctcctatagttgttcttgattcaattacatttttatttatttggtagggtcccaagaaaaaagggtaatctttatgcattcctgaggtctgttcttgaacatggctcttttttatgtgtca

SEQ ID NO: 3592 - DNA, 779 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacattcctcaattcttgtgccataccatggatggttagttcatactggctttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaatgggaatctttatgcttcctgaggctgttcttgaacatggctcttttttatgtgcattatcttagttaa

SEQ ID NO: 3593 - DNA, 710 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacactgcattgcctccattcattgttgcgcataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaaccaaaatttttattttgataaaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggta

SEQ ID NO: 3594 - DNA, 476 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatgttgccggtgctgtgccaggcccacggcttgaccccggagcaggtggtggccatcgccagcaatattcctcaattcttgtgccataccatggatggttagttcatactggcttttttgtttgttcatttgtcattgaaaaaaaactcttttgttgattcaattattttatagtgtgtttggaagcccgtttgagaaaataagaaatcgcatctggaatgtgaaagttataactatttagcttcatttgtcgttgcaagttcttttattggttaaatttttatagcg

SEQ ID NO: 3595 - DNA, 777 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacagcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaaagggtaatctttatgcagttcctgaggtctgttcttgaacatggctcttttttatgtgtca

SEQ ID NO: 3596 - DNA, 784 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacgcattcctcaattcttgtgccataccatggatggttagttcatactggcttttttgtttgttcatttgtcattgaaaaaaaagtcttttgttgattcaattatttttatagtgtgtttggaagcccgtttgagaaaaattaagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaagccatggacacattgagaaggatgagtcatgggttccagtatgtgattaattgcttctcctatagttgttcttgattcaattacattttatttatttggtagggtccaagaaaaaatgggaatctttatgcttcctgaggctgttcttgaacaggctcttttttatgtgcattatcttagtt

SEQ ID NO: 3597 - DNA, 679 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgatt

SEQ ID NO: 3598 - DNA, 795 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtcccaagaaaaaaatgggtaatcttttaatggctttcctgaggtctgtttctttgaaacatgggctctttttttatgtgtcatatcttag

SEQ ID NO: 3599 - DNA, 786 bp, Artificial
  Glycine max FAD3B mutation created with TALEN pair GmFAD3_T02.1
  misc_feature (292): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacactgcattgctccattcattgttgccataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaagggaatcttttatgcttcctgaggctgttcttgaacatggctcttttttatgtgtcattatctagttaa

SEQ ID NO: 3600 - DNA, 677 bp, Artificial
  Glycine max FAD3B mutation created with TALEN pair GmFAD3_T02.1
ctcacacattgttctgttatgtcatttcttcttcatttggctttagacaacttaaatttgagatctttattatgttttttgcttatatggtaaagtgattcttcattatttcattcttcattgattgaattgaacagtggccatggaagcttttcagatagccctttgctgaatagcctggtgggacagcattcctcaattcttgtgccataccatggatggttagttcatactggctttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgatt

SEQ ID NO: 3601 - DNA, 767 bp, Artificial
  Glycine max FAD3B mutation created with TALEN pair GmFAD3_T02.1
ctcacacattgttctgttatgtcatttcttcttcatttggctttagacaacttaaatttgagatctttattatgttttttgcttatatggtaaagtgattcttcattatttcattcttcattgattgaattgaacagtggccatggaagcttttcagatagccctttgctgaatagcctggtggggacattgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaagggtaatctttatgcattcctgaggctgttcttgaacatggctctttttt

SEQ ID NO: 3602 - DNA, 796 bp, Artificial
  Glycine max FAD3B mutation created with TALEN pair GmFAD3_T02.1
ctcacacattgttctgttatgtcaatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacctcaattcttgtgccataccatggatggttagttcatactggctttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtcccaaagaaaaaaaatggggtaagtctttttaatggctttccctgaggctgtttcttgaacatggctcttttttaatgtgcatttatcttagttaa

SEQ ID NO: 3603 - DNA, 695 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtggggacacgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttattta

SEQ ID NO: 3604 - DNA, 788 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtggggacactgcattgccttccattcattgttgcgcataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaaagggaatctttatgcttcctgaggctgttcttgaacatggctcttttttatgtgcattatcttagttt

SEQ ID NO: 3605 - DNA, 683 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattac

SEQ ID NO: 3606 - DNA, 787 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggataagtgtattctttcattatttcattcttcattgattgaattgaacagctggccatggaagcttttcagatagccctttgctgaatagcctggtgggacacagcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaagggaatctttatgcttcctgaggctgttcttgaacatggctcttttttatgtgtcattatcttagttaa

SEQ ID NO: 3607 - DNA, 767 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacagcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaagggtaatctttatgcattcctgaggtctgttcttgaacatggctctttttt

SEQ ID NO: 3608 - DNA, 802 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtggggacacgcattgccattccattcattgcttgtcgcataccatggatggttagttcatactggcttttttgtttgttcatttgtcattgaaaaaaaagtcttttgttgattcaattatttttatagtgtgtttggaagcccgtttgagaaaaataagaaatcgcatctggaatgtgaaaagttataactatttagcttcatttgtcgttgcaagttcttttattggttaaaatttttatagcgtgctaggaaaacccattcgagaaaataagaaatcacatctggaatgtgaaagttataactgttagcttctgagtaaacgtggaaaaaaccacattttggatttggaaaccaaaattttattttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacatttttatttatttggtagggtccaagaaaaaatgggaagtcttttatgcttcctgaggtctgttcttgaacatggctcttttttatgtgtcatatctagtt

SEQ ID NO: 3609 - DNA, 790 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtggggacacagcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaaagggtaatctttatgcattcctgaggctgttcttgaacatggctcttttttatgtgtcatttatcttagttaa

SEQ ID NO: 3610 - DNA, 765 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacagcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaaagggtaatctttatgcattcctgaggctgttcttgaacatggctctttttt

SEQ ID NO: 3611 - DNA, 504 bp, Artificial
  Glycine max FAD3B mutation created with TALEN pair GmFAD3_T02.1
ctcacacattgttctgttatgtcatttcttcttcatttggctttagacaacttaaatttgagatctttattatgttttttgcttatatggtaaagtgattcttcattatttcattcttcattgattgaattgaacagtggccatggaagcttttcagatagccctttgctgaatagcctggtgggacattgcattcctcaattcttgtgccataccatggatggttagttcatactggcttttttgtttgttcatttgtcattgaaaaaaaagtcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaaataagaaatcacatctggaatgtgaaagttataactgttagcttctgagtaaacgtggaaaaa

SEQ ID NO: 3612 - DNA, 708 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacatttttatttatttggtagggt

SEQ ID NO: 3613 - DNA, 786 bp, Artificial
  Glycine max FAD3B mutation created with TALEN pair GmFAD3_T02.1
ctcacacattgttctgttatgtcatttcttcttcatttggctttagacaacttaaatttgagatctttattatgttttttgcttatatggtaatgtgattcttcattatttcattcttcattgattgaattgaacagtggccatggaagcttttcagatagccctttgctgaatagcctggtgggacagcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaagggtaatctttatgcattcctgaggtctgttcttgaacatggctcttttttatgtgtcattatcttagttaa

SEQ ID NO: 3614 - DNA, 789 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacttcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtcccaagaaaaaaagggtaatcttttaatgcttcctgaggtctgttctttgaacatgggctctttttttatgtgtcatatcttagttaa

SEQ ID NO: 3615 - DNA, 706 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtggggacacgcattgcctcattcattgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggt

SEQ ID NO: 3616 - DNA, 727 bp, Artificial
  Glycine max FAD3B mutation created with TALEN pair GmFAD3_T02.1
ctcacacattgttctgttatgtcatttcttcttcatttggcttagacaacttaaatttgagatcttattatgttttgcttatatggtaaagtgattcttcattatttcattcttcattgattgaattgaacagtggccatggaagctttcagatagcccttgctgaatagcctggtgggagcatcctcaattcttgtccgtccaattcattgcctgatccggaattaggccttaagtttcggaattggattagttccattactggggcctttttttttggtttttggttttccaattttggttccaatttgaaaaaaaaagtcctttttggtttgaatttccaaatttatttttatagtgtgtttggaaagcccgtttgagaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttg

SEQ ID NO: 3617 - DNA, 793 bp, Artificial
  Glycine max FAD3B mutation created with TALEN pair GmFAD3_T02.1
  misc_feature (301): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtggggacactgtcatttgccattccattcatttgcttgcgcataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggaatctttatgcttcctgaggctgttcttgaacatggctcttttttatgtgcattatcttagttaa

SEQ ID NO: 3618 - DNA, 740 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtggggacattgcattcctcaattcttgtgccataccatggatggttagttcatactggcttttttgtttgttcatttgtcattgaaaaaaaagtcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaagccatggacacattgagaaggatgagtcatgggttccagtatgtgattaattgcttctcctatagttgttcttgattcaattacattttatttatttggtagggtccaagaaaaatgggaatctttatgcttcctga

SEQ ID NO: 3619 - DNA, 705 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagacagccctttgctgaatagcctggtgggacagcattcctcaattcttgtgccataccatggatggttagttcatactggcttttttgtttgttcatttgtcattgaaaaaaaagtcttttgttgattcaattatttttatagtgtgtttggaagcccgtttgagaaaaataagaaatcgcatctggaatgtgaaagttataactatttagcttcatttgtcgttgcaagttcttttattggttaaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggt

SEQ ID NO: 3620 - DNA, 864 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacactttgaatttaaagctaatttggttcaaaacaaagcctaaagttaattaaaatgtcaaataaacatcacaaaatgcacttgcattcctcaattcttgtgccataccatggatggttagttcatactggcttttttgtttgttcatttgtcattgaaaaaaaattcttttgttgattcaattatttttatagtgtgttttggaaagcccgttttgagaaaaataagaaatcgcatctggaatgtgaaagttataactatttagcttcatttgtcgttgcaagttcttttattggttaaatttttatagcgtgctaggaaacccattcgagaaaaataagaaatcacatctggaatgtgaaagttataactgttagcttctgagtaaacgtggaaaaaaccacattttgggatttggaaccaaaatttatttgataaatgacaaccaaattgatttgatggatttgcaggaagaattagccacagaactcaccatcaaaatccatggacacattgagaaggatgagtcatgggttccagtatgtgattaattgcttctcctatagttgttcttgattcaattacattttatttatttggtaggtccaagaaaaagggaatctttatgcttcctgaggctgttcttgaacatggctcttttttatgtgtcattatcttag

SEQ ID NO: 3621 - DNA, 493 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacagcattcctcaattcttgtgccataccatggatggttagttcatactggcttttttgtttgttcatttgtcattgaaaaaaaagtcttttgttgattcaattatttttatagtgtgtttggaagcccgtttgagaaaaataagaaatcgcatctggaatgtgaaaagttataactatttagcttcatttgtcgttgcaagttcttttattggttaaaatttttatagcgtgctaggaaacccattcgagaaaataagaaatcacatctggaatgtgaaagttataactgttagtttctgagtaaa

SEQ ID NO: 3622 - DNA, 785 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggactcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaaagggaatctttatgcttcctgaggctgttcttgaacatggctcttttttatgtgcattatcttagttaa

SEQ ID NO: 3623 - DNA, 684 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggataagtgtattctttcattatttcattcttcattgattgaattgaacagctggccatggaagcttttcagatagccctttgctgaatagcctggtggggacacagcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacatgaactcaccatcaaaaccatggacacattgagaaaggatgagtcatgggttccagtatgtgattaattgcttctcctatagttgttcttgattc

SEQ ID NO: 3624 - DNA, 769 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggagcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaaagggaatctttatgcttcctgaggctgttcttgaacatggctcttttttatgtgtca

SEQ ID NO: 3625 - DNA, 577 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttcctcaattcttgtgccataccatggatggttagttcatactggcttttttgtttgttcatttgtcattgaaaaaaaactcttttgttgattcaattattttttatagtgtgtttggaagcccgtttgagaaaataagaaatcgcatctggaatgtgaaagttataactatttagcttcatttgtcgttgcaagttcttttattggttaaaatttttatagcgtgctaggaaaacccattcgagaaaataagaaatcacatctggaatgtgaaagttataactgttagcttctgagtaaacgtggaaaaaatccacatttttatgggattttgggaaacccaaaaatttttattttgataaaatgacaaccaaaattgattttgatggattttgcaggagaattagccacag

SEQ ID NO: 3626 - DNA, 778 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaaatgggaatctttatgcttcctgagggctgttcttgaacatggctctttttttatgtgcattatc

SEQ ID NO: 3627 - DNA, 688 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacagcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaaatttttatagcgtgctaggaaaacccattcgagaaaaataagaaatcacatctggaatgtgaaagttataactgttagcttctgagtaaacgtggaaaaaaccacattttggatttggaaccaaaattttatttgataaatgacaaaccaaaattgattttgatggattttgcaggagaattagccacagaactcaccatcaaaaaccatggacacattgagaaaggatgagtcatgggttccagtatgtgattaattgcttctcctatagttgttcttgattc

SEQ ID NO: 3628 - DNA, 792 bp, Artificial
  Glycine max FAD3B mutation created with TALEN pair GmFAD3_T02.1
  misc_feature (298): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtggggacacagtcatttgccttccattcattgttgcgcataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaagggaatctttatgcttcctgaggctgttcttgaacatggctcttttttatgtgtcatttatctagttaa

SEQ ID NO: 3629 - DNA, 786 bp, Artificial
  Glycine max FAD3B mutation created with TALEN pair GmFAD3_T02.1
  misc_feature (293): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacactgcattgcctcattcattgttgcgcataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggaatctttatgcttcctgaggctgttcttgaacatggctcttttttatgtgtcattatcttagttaa

SEQ ID NO: 3630 - DNA, 695 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttgg

SEQ ID NO: 3631 - DNA, 765 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagcccttttcagatagcattcctcaattcttgtgccataccatggatggttagttcatactggcttttttgtttgttcatttgtcattgaaaaaaactctttttgttgattcaattatttttatagtgtgtttggaagcccgtttgagaaaataagaaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagtcacagaactcaccatcaaaaccatggacacattgagaaggatgagtcatgggttccagtatgtgattaattgcttctcctatagttgttcttgattcaattacattttatttatttggtagggtccaagaaaaagggaatctttatgcttcctgaggctgttcttgaacatggctcttttttatgtgcatttatcttta

SEQ ID NO: 3632 - DNA, 786 bp, Artificial
  Glycine max FAD3B mutation created with TALEN pair GmFAD3_T02.1
  misc_feature (294): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacactgcattgctccattcattgttgcgcataccatggatggttagttcatactggcttttttgtttgttcatttgtcattgaaaaaaaagtcttttgttgattcaattntttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttgatttgataaatgacaaccaaattgattttgatggattttgcaggagaattagccacagaactcaccatcaaaagccatggacacattgagaaggatgagtcatgggttccagtatgtgattaattgcttctcctatagttgttcttgattcaattacattttatttatttggtaggtccaagaaaaatgggaatctttatgcttcctgaggctgttcttgaacatggctcttttttatgtgcattatcttag

SEQ ID NO: 3633 - DNA, 792 bp, Artificial
  Glycine max FAD3B mutation created with TALEN pair GmFAD3_T02.1
  misc_feature (299): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtggggacacagtcatttgccattccattcattgttgcgcataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggaatctttatgcttcctgaggctgttcttgaacatggctcttttttatgtgtcattatcttagttaa

SEQ ID NO: 3634 - DNA, 783 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatctatcgcgtattaaatgtataattgcgggactctaatcataaaaacccatctcataaataacgtcatgcattacatgttaattattacatgcttaacgtaatactggcttttttgtttgttcatttgtcattgaaaaaaaattcttttgttgattcaattatttttatagtgtgttttggaaagcccgttttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaaccacattttgggatttggaaccaaaattttatttgataaatgacaaccaaattgatttgatgatttgcaggagaattagccacagaatctcaccatcaaaatccatggacacattgagaaggatgagtcatgggttccagtatgtgattaattgcttctcctatagttgttcttgattcaattacattttatttatttggtaggtccaagaaaaaggg

SEQ ID NO: 3635 - DNA, 740 bp, Artificial
  Glycine max FAD3B mutation created with TALEN pair GmFAD3_T02.1
ctcacacattgttctgttatgtcatttcttcttcatttggctttagacaacttaaatttgagatctttattatgttttttgcttatatggtaaagtgattcttcattatttcattcttcattgattgaattgaacagtggccatggaagcttttcagatagccctttgctgaatagcctggtggggaccgcattcctcaattcttgtgccataccatggatggttagttcatactggctttttttgtttgttcatttgtcattgaaaaaaaagtcttttgttgattcaattatttttatagtgtgtttggaagcccgtttgagaaaaataagaaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaatccacattttggatttggaaccaaaattttatttgataaatgacaaccaaattgattttgatggattttgcaggagaattagccacagaactcaccatcaaaaagccatggacacattgagaaggatgagtcatgggttccagtatgtgattaattgcttctcctatagttgttcttgattcaaattacattttatttatttggtagggtccaagaaaaaaatgggaatcttttat

SEQ ID NO: 3636 - DNA, 663 bp, Artificial
  Glycine max FAD3B mutation created with TALEN pair GmFAD3_T02.1
ctcacacattgttctgttatgtcatttcttcttcatttggctttagacaacttaaattttgagatctttattatgttttttgcttatatggtaaagtgattcttcattatttcattcttcattgattgaattgaacagtggccatggaagcttttcagatagcccctttgctgaatagcctggtggggacagcattcctcaattcttgtgccataccatggatggttagttcatactggcttttttgtttgttcatttgtcattgaaaaaaaagtcttttgttgattcaattatttttatagtgtgtttggaagcccgtttgagaaaaattaagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaatccacattttggatttggaaccaaattttgatttgataaatgacaaccaaattgattttgatggattttgcaggagaattagccacagaactcaccatcaaaagccatggacacattgagaaggatgagtcatgggttccagtatgtgattaattgctt

SEQ ID NO: 3637 - DNA, 792 bp, Artificial
  Glycine max FAD3B mutation created with TALEN pair GmFAD3_T02.1
  misc_feature (299): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtggggacactgtcatttgccattccattcattgttgcgcataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaagggaatctttatgcttcctgaggctgttcttgaacatggctcttttttatgtgtcattatctagttaa

SEQ ID NO: 3638 - DNA, 783 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggattcctcaattcttgtgccataccatggatggttagttcatactggctttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacatgaactcaccatcaaaaccatggacacattgagaaggatgagtcatgggttccagtatgtgattaattgcttctcctatagttgttcttgattcaattacattttatttatttggtagggtccaagaaaaagggtaatctttatgcagttcctgaggtctgttcttgaacatggctcttttttatgtgtcattatcttagttaa

SEQ ID NO: 3639 - DNA, 689 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacagcattcctcaattcttgtgccataccatggatggttagttcatactggcttttttgtttgttcatttgtcattgaaaaaaaagtcttttgttgattcaattatttttatagtgtgtttggaagcccgtttgagaaaaattaagaaaatcgcatctggaatgtgaaaagttataactatttagcttcatttgtcgttgcaagttcttttattggttaaatttttatagcgtgctaggaaacccattcgagaaaaagtaagaaattcacatctggaatgtgaaagttataactgttaagcttctgagtaaacgtggaaaaatccacattttggatttggaaccaaattttgatttgataaatgacaaccaaattgattttgatggattttgcaggagaattagccacagaactcaccatcaaaagccatggacacattgagaaggatgagtcatgggttccagtatgtgattaattgcttctcctatagttgttcttgattc

SEQ ID NO: 3640 - DNA, 789 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacattgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaagggtaatctttatgcattcctgaggctgttcttgaacatggctcttttttatgtgtcatttatcttagttaa

SEQ ID NO: 3641 - DNA, 689 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacagcattcctcaattcttgtgccataccatggatggttagttcatactggcttttttgtttgttcatttgtcattgaaaaaaaagtcttttgttgattcaattatttttatagtgtgtttggaagcccgtttgagaaaaattaagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttgatttgataaatgacaaccaaattgattttgatggattttgcaggagaattagccacagaactcaccatcaaaagccatggacacattgagaaggatgagtcatgggttccagtatgtgattaattgcttctcctatagttgttcttgattcaattaca

SEQ ID NO: 3642 - DNA, 764 bp, Artificial
  Glycine max FAD3B mutation created with TALEN pair GmFAD3_T02.1
ctcacacattgttctgttatgtcatttcttcttcatttggctttagacaacttaaatttgagatctttattatgttttttgcttatatggtaaagtgattcttcattatttcattcttcattgattgaattgaacagtggccatggaagcttttcagatagccctttgctgaatagcctggtgggacacattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaagggtaatctttatgcattcctgaggctgttcttgaacatggctcttttttt

SEQ ID NO: 3643 - DNA, 688 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacgcattcctcaattcttgtgccataccatggatggttagttcatactggcttttttgtttgttcatttgtcattgaaaaaaaagtcttttgttgattcaattatttttatagtgtgtttggaagcccgtttgagaaaaattaagaaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaatccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattaca

SEQ ID NO: 3644 - DNA, 750 bp, Artificial
  Glycine max FAD3B mutation created with TALEN pair GmFAD3_T02.1
ctcacacattgttctgttatgtcatttcttcttcatttggctttagacaacttaaatttgagatctttattatgttttttgcttatatggtaaagtgattcttcattatttcattcttcattgattgaattgaacagtggccatggaagcttttcagatagccctttgctgaatagcctggtgggattgcattcctcaattcttgtgccataccatggatggttagttcatgatttcttggctttttttgtttgttaacatttgttcattgaaaaaaaagttctttttgtttgattcaattatttttatagttgtgtttggaacgtcccgtttagagaaaaattaagaaatcgcatctggaatgtgaaaagttataactatttagcttcatttgtcgttgcaagttcttttattggttaaaattttttatagcgtgctaggaaaacccattcgagaaaaataagaaatcacatctggaatgtgaaagttataactgttagcttctgagtaaacgtggaaaaaaccacattttggatttggaaaccaaaatttttattttgataaaatgacaaccaaattgattttgattggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaaatgggaa

SEQ ID NO: 3645 - DNA, 779 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggaatctttatgcattcctgaggctgttcttgaacatggctcttttttaatgtgtcatttatc

SEQ ID NO: 3646 - DNA, 753 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagcccttttcagatagcattcctcaattcttgtgccataccatggatggttagttcatactggcttttttgtttgttcatttgtcattgaaaaaaatcttttgttgattcaattatttttatagtgtgtttggaagcccgtttgagaaaataagaaaatcgcatctggaatgtgaaagttataactatttagcttcatttgtcgttgcaagttcttttattggttaaatttttatagcgtgctaggaaacccattcgagaaaaataagaaatcacatctggaatgtgaaagttataactgttagcttctgagtaaacgtggaaaaaccacattttggatttggaaccaaaattttatttgataaatgacaaccaaattgattttgatggattttgcaggagaattagtcacagaactcaccatcaaaaccatggacacattgagaaggatgagtcatgggttccagtatgtgattaattgcttctcctatagttgttcttgattcaaattacattttatttatttggtagggtccaagaaaaaaagggtaatctttatgcattcctgaggctgttcttgaacatggctctttttt

SEQ ID NO: 3647 - DNA, 738 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacagcttgcctccattcattgttgcgcataccatggatggttagttcatactggcttttttgtttgttcatttgtcattgaaaaaaaagtcttttgttgattcaattatttttatagtgtgtttggaagcccgtttgagaaaaattaagaaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtcccaagaaaaaaaatgggaatctttta

SEQ ID NO: 3648 - DNA, 793 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaaattagccacagaactcaccatcaaaaccatggacacattgagaaggatgagtcatgggttccagtatgtgattaattgcttctcctatagttgttcttgattcaattacattttatttatttggtagggtccaagaaaaaagggtaatctttatgcattcctgaggtctgttcttgaacatggctcttttttatgtgtcatttatcttagttaa

SEQ ID NO: 3649 - DNA, 729 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacagcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaaaatgggaatcttta

SEQ ID NO: 3650 - DNA, 758 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcatctccaggatacggtcctgggtgctgttccgggcgatctcgatcagctcgatgtactcgtgtgcattcctcaattcttgtgccataccatggatggttagttcatactggcttttttgtttgttcatttgtcattgaaaaaaaagtcttttgttgattcaattatttttatagtgtgtttggaagcccgtttgagaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaagttataactgttagcttctgagtaaacgtggaaaaacgcacattttgggatttggaaccaaatttatttgataaatgacaatccaaattgatttgattggttttggcaggaagaattagccacagaatctcaccatcaaaatccatggacacattgagaaggatgagtatgggttccagtatgtgattaattgcttctcctatagttgttcttgattcaattacattttt

SEQ ID NO: 3651 - DNA, 683 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggactcttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacatgaactcaccatcaaaaagccatggacacattgagaaggatgagtcatgggttccagtatgtgattaattgcttctcctatagttgttcttgattc

SEQ ID NO: 3652 - DNA, 844 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatctatcgcgtattaaatgtataattgcgggactctaatcataaaaacccatctcataaataacgtcatgcattacatgttaattattacatgcttaacgtaatactggcttttttgtttgttcatttgtcattgaaaaaaaatcttttgttgattcaattatttttatagtgtgttttggaaagcccgttttgagaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaaccacattttgggatttggaaccaaaatttatttgataaaatgacaaccaaattgatttgatgattttgcaggagaattagccacagaatctcaccatcaaaaccatggacacattgagaaggatgagtcatgggttccagtatgtgattaattgcttctcctatagttgttcttgattcaattacattttatttatttggtaggtccaagaaaaagggaatctttatgcttcctgaggctgttgcttgaacatggctcttttttatgtgtcattatcttag

SEQ ID NO: 3653 - DNA, 793 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaaagggtaatctttatgcagttcctgaggctgttcttgaacatggctcttttttaatgtgtcatttatcttagttaa

SEQ ID NO: 3654 - DNA, 507 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggactcttgcattcctcaattcttgtgccataccatggatggttagttcatactggcttttttgtttgttcatttgtcattgaaaaaaaagtcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccaca

SEQ ID NO: 3655 - DNA, 774 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacaattcttgtgccataccatggatggttagttcatactggcttttttgtttgttcatttgtcattgaaaaaaatcttttgttgattcaattatttttatagtgtgtttggaagcccgtttgagaaaataagaaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaagggtaatctttatgcattcctgaggtctgttcttgaacatggctcttttttatgtgtcattatcttagttaa

SEQ ID NO: 3656 - DNA, 787 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacattcctcaattcttgtgccataccatggatggttagttcatactggctttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttattttgataaatgacaaccaaattgattttgatggattttgcaggagaattagccacagaactcaccatcaaaaaccatggacacattgagaaggatgagtcatgggttccagtatgtgattaattgcttctcctatagttgttcttgattcaattacattttatttatttggtagggtccaagaaaaagggaatctttatgcattcctgaggctgttcttgaacatggctcttttttatgtgtcatttatcttagttaa

SEQ ID NO: 3657 - DNA, 776 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacagcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaaagggtaatctttatgcagttcctgaggtctgttcttgaacatggctcttttttatgtgtca

SEQ ID NO: 3658 - DNA, 743 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggagcatcctcaattctttgtgtccataatcctatggcatgcttagttcgatgatgtctactgggcttttttttgttttgttcatttgtcattgaaaaaaaaagtcttttgttgattcaattatttttatagtgtgtttggaagcccgtttgagaaaaataagaaaatcgcatctggaatgtgaaagttataactatttagcttcatttgtcgttgcaagttcttttattggttaaaattttttatagcgtgctaggaaacccattcgagaaaataagaaaatcacatctggaatgtgaaagttataactgttagcttctgagtaaacgtggaaaaaaccacattttggatttggaaccaaattttatttgataaatgacaaccaaattgattttgatggattttgcaggagaattagccacagaactcaccatcaaaaaccatggacacattgagaaggatgagtcatgggttccagtatgtgattaattgcttctcctatagttgttcttgattcaattacattttatttatttggtaggtccaagaaaaatgggaatc

SEQ ID NO: 3659 - DNA, 515 bp, Artificial
  Glycine max FAD3B mutation created with TALEN pair GmFAD3_T02.1
ctcacacattgttctgttatgtcatttcttcttcatttggctttagacaacttaaatttgagatctttattatgttttttgcttatatggtaaagtgattcttcattatttcattcttcattgattgaattgaacagtggccatggaagcttttcagatagccctttgctgaatagcctggtggggacattgcattcctcaattcttgtgccataccatggatggttagttcatactggcttttttgtttgttcatttgtcattgaaaaaaaagtcttttgttgattcaattatttttatagtgtgtttggaagcccgtttgagaaaaattaagaaaatcgcatctggaatgtgaaaagttataactatttagcttcatttgtcgttgcaagttcttttattggttaaatttttcatagcgtgctaggaaacccattcgagaaaagtaagaaattcacatctggaatgtgaaagttataactgttagcttctgagtaaacgtggaaaaatccaca

SEQ ID NO: 3660 - DNA, 731 bp, Artificial
  Glycine max FAD3B mutation created with TALEN pair GmFAD3_T02.1
ctcacacattgttctgttatgtcatttcttcttcatttggctttagacaacttaaatttgagatctttattatgttttttgcttatatggtaaagtgattcttcattatttcattcttcattgattgaattgaacagtggccatggaagcttttcagatagccctttgctgaatagcctggtgggaccgcattcctcaattcttgtgccataccatggatggttagttcatactggctttttttgtttgttcatttgtcattgaaaaaaaaatcttttgttgattcaattatttttatagtgtgttttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttatttgataaatgacaaccaaattgattttgatggattttgcaggagaattagccacagaactcaccatcaaaaccatggacacattgagaaaggatgagtcaatgggttccagtatgtgattaattgcttctcctatagttgttcttgattcaattacattttatttatttggtagggtcccaaagaaaaaaagggtaa

SEQ ID NO: 3661 - DNA, 670 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgatt

SEQ ID NO: 3662 - DNA, 873 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatctggagacggtccagcggctgttgccggtgctgtgccaggcccacggcttgaccccccagcaggtggtggccatcgccagcaataatggtgattcctcaattcttgtgccataccatggatggttagttcatactggctttttgtttgttcatttgtcattgaaaaaaactcttttgttgattcaattatttttatagtgtgtttggaagcccgtttgagaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttatttgataaatgacaaccaaattgattttgatggatttttgcaggagaatttagccacagaactcaccatcaaaaccatggacacattgagaaggatgagtcatgggttccagtatgtgattaattgcttctcctatagttgttcttgattcaattacattttattttattttggtaggtccaagaaaaaagggtaatcttttatgcttcctgtggctgttcttgaacaatggctctttttatgtgtcattatctta

SEQ ID NO: 3663 - DNA, 788 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacactgcattcctcaattcttgtgccataccatggatggttagttcatactggcttttttgtttgttcatttgtcattgaaaaaaaatcttttgttgattcaattatttttatagtgtgttttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggaatctttatgcattcctgaggtctgttcttgaacatggctcttttttatgtgtcattatcttagttaa

SEQ ID NO: 3664 - DNA, 852 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcaacgcggccaacgccggatcagggcgagataactgggcaacaatgctctccagcgccggcctgccgccgccattgctggcgatggccaccacctgctgaggggtttgcattcctcaattcttgtgccataccatggatggttagttcatactggctttttgtttgttcatttgtcattgaaaaaaagtcttttgttgattcaattatttttatagtgtgtttggaagcccgtttgagaaaataagaaatcgcatctggaatgtgaaagttataactatttagcttcatttgtcgttgcaagttcttttattggttaaaatttttatagcgtgctaggaaacccattcgagaaaataagaaatcacatctggaatgtgaaagttataactgttagcttctgagtaaacgtgggaaaaaccacattttggatttggaaccaaatttttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggaatctttatgcttcctgaggctgttc

SEQ ID NO: 3665 - DNA, 768 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacagcaataatggtggcaagcaggcgctggagacggtccagcggctgttgccggtgctgtgccaggcccacggcttgacccccagcaggtggtggcaggcgctggagacgcattcctcaattcttgtgccataccatggatggttagttcatactggctttttcgtttgttcatttgtcattgaaaaaaagtcttttgttgattcaattatttttatagtgtgtttggaagcccgtttgagaaaaataagaaatcgcatctggaattgtgaaagttataactattagcttcatttgtcgttgcaagttcttttattggttaaatttttatagcgtgctaggaaacccattcgagaaaataagaatcacatctggaatgtgaaagttatactgttagcttctgagtaaacgtgggaaaaagccaacattttggatttggaaccaaatttttatttgataaatgacaaccaaaatttgattttgatggcatttttggtcaggagaattagccaacagaactcaccatcaaaagccatggacacaattgagaaggattgagtcatgggttccagtatgtgattaa

SEQ ID NO: 3666 - DNA, 702 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacattcctcaattcttgtgccataccatggatggttagttcatactggctttttttgtttgttcatttgtcattgaaaaaaaagtcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggt

SEQ ID NO: 3667 - DNA, 768 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacactgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacatttttatttatttggtagggtcccaagaaaaaagggtaatctttatgcattcctgaggctgttcttgaacatggctctttttt

SEQ ID NO: 3668 - DNA, 758 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacaaacttggtctgacagttaccaatgcttaatcagtgaggcacctatctcagcgatctgtctatttcgttcatccatagttgcctgactccccgtcgtgtagataacaggcattcctcaattcttgtgccataccatggatggttagttcatactggcttttttgtttgttcatttgtcattgaaaaaaactcttttgttgattcaattatttttatagtgtgttttggaagcccgtttgagaaataagaaatcgcatctggatgtgaaagttataactatttagcttcatttgtcgttgcaagttctttattggttaaatttttatagcgtgctaggaaacccattcgagaaaataagaaatcacatctggaatgtgaaagttataactgttagcttctgagtaaacgtggaaaaatccacatttgggatttggaaccaaattttatttgataaatgacaaccaaattgatttttgatggatttttgcaggagaattagccacagaactcaccatcaaaaccatggacacattgagaaggatgagtcatgggttccaagtatgtgattaa

SEQ ID NO: 3669 - DNA, 790 bp, Artificial
  Glycine max FAD3B mutation created with TALEN pair GmFAD3_T02.1
  misc_feature (295): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacactgcattgccttccattcattgttgcgcataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttattttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaaagggaatctttatgcttcctgaggctgttcttgaacatggctcttttttatgtgtcattatctagttaa

SEQ ID NO: 3670 - DNA, 684 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtggggacacagcattgccttccattcattgttgcgcataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgatt

SEQ ID NO: 3671 - DNA, 685 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagcccttttgctgaatagccttggtgcattcctcaattctttgtgccataccatggatggttagttcatactggctttttttgtttgttcatttgtcattgaaaaaaaatcttttgttgattcaattatttttatagtgtgtttggaagcccgtttgagaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacatttta

SEQ ID NO: 3672 - DNA, 700 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtggcattcctcaattcttgtgccataccatggatggttagttcatactggctttttttgtttgttcatttgtcattgaaaaaaaagtcttttgttgattcaattatttttatagtgtgtttggaagcccgtttgagaaaaattaagaaaatcgcatctggaatgtgaaagttataactatttagcttcatttgtcgttgcaagttcttttattggttaaatttttatagcgtgctaggaaacccattcgagaaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaaccatggacacattgagaaggatgagtcatgggttccagtatgtgattaattgcttctcctatagttgttcttgattcaattacattttatttatttggta

SEQ ID NO: 3673 - DNA, 780 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaatgggaatctttatgcttcctgaggctgttcttgaacatggctcttttttatgtgcattatcttag

SEQ ID NO: 3674 - DNA, 781 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacagcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaagccatggacacattgagaaggatgagtcatgggttccagtatgtgattaattgcttctcctatagttgttcttgattcaattacattttatttatttggtagggtccaagaaaaagggaatctttatgcttcctgaggctgttcttgaacatgggctctttttttatgtgtcatatctag

SEQ ID NO: 3675 - DNA, 725 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacagcattcctcaattcttgtgccataccatggatggttagttcatactggcttttttgtttgttcatttgtcattgaaaaaaaatcttttgttgattcaattatttttatagtgtgtttggaagcccgtttgagaaaaattaagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtcccaagaaaaaaagggtaa

SEQ ID NO: 3676 - DNA, 762 bp, Artificial
  Glycine max FAD3B mutation created with TALEN pair GmFAD3_T02.1
ctcacacattgttctgtatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtggggacacatctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtcccaagaaaaaagggtaatctttatgcattcctgaggctgttcttgaacatggctctttttt

SEQ ID NO: 3677 - DNA, 694 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacattcctcaattcttgtgccataccatggatggttagttcatactggcttttttgtttgttcatttgtcattgaaaaaaaagtcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaagccatggacacattgagaaggatgagtcatgggttccagtatgtgattaattgcttctcctatagttgttcttgattcaattacattttatttattt

SEQ ID NO: 3678 - DNA, 789 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacgcattcctcaattcttgtgccataccatggatggttagttcatactggcttttttgtttgttcatttgtcattgaaaaaaaagtcttttgttgattcaattatttttatagtgtgtttggaagcccgtttgagaaaaataagaaatcgcatctggaatgtgaaaagttataactatttagcttcatttgtcgttgcaagttcttttattggttaaaatttttatagcgtgctaggaaacccattcgagaaaaataagaaatcacatctggaatgtgaaagttataactgttagcttctgagtaaacgtggaaaaaccacattttggatttggaaccaaaatttttattttgataaatgacaaccaaattgattttgatggattttgcaggagaattagccacagaactcaccatcaaaaccatggacacattgagaaggatggagtcatgggttccagtatgtgattaattgcttctcctatagttgttcttgattcaattacatttttatttatttggtagggtccaagaaaaatgggaagtctttatgcttcctgaggctgttcttgaacatggctcttttttatgtgcattatcttag

SEQ ID NO: 3679 - DNA, 679 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattc

SEQ ID NO: 3680 - DNA, 789 bp, Artificial
  Glycine max FAD3B mutation created with TALEN pair GmFAD3_T02.1
ctcacacattgttctgttatgtcatttcttcttcatttggctttagacaacttaaatttgagatctttattatgttttttgcttatatggtaaagtgattcttcattatttcattcttcattgattgaattgaacagtggccatggaagcttttcagatagccctttgctgaatagcctggtggggacagcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaaagggtaatctttatgcattcctgaggctgttcttgaacatggctcttttttatgtgtcatttatcttagttaa

SEQ ID NO: 3681 - DNA, 782 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacactgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggaatctttatgcttcctgaggctgttcttgaacatggctcttttttatgtgcattatcttagttaa

SEQ ID NO: 3682 - DNA, 767 bp, Artificial
  Glycine max FAD3B mutation created with TALEN pair GmFAD3_T02.1
ctcacacattgttctgttatgtcatttcttcttcatttggctttagacaacttaaatttgagatctttattatgttttttgcttatatggtaaagtgattcttcattatttcattcttcattgattgaattgaacagtggccatggaagcttttcagatagccctttgctgaatagcctggtgggacattgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttatttgataaatgacaaccaaattgattttgatggattttgcaggagaattagccacagaactcaccatcaaaaccatggacacattgagaaggatgagtcatgggttccagtatgtgattaattgcttctcctatagttgtttcttgattccaattacatttttattttatttggtagggtcccaagaaaaaagggtaatcttttatgcattcctgaggtctgttcttgaacatggc

SEQ ID NO: 3683 - DNA, 712 bp, Artificial
  Glycine max FAD3B mutation created with TALEN pair GmFAD3_T02.1
  misc_feature (475): n is a or c or t or g
ctcacacattgttctgttatgtcatttcttcttcatttggctttagacaacttaaatttgagatctttattatgttttttgcttatatggtaaagtgattcttcattatttcattcttcattgattgaattgaacagtggccatggaagcttttcagatagccctttgctgaatagcctggtgggacacagcattcctcaattcttgtgccataccatggatggttagttcatactggcttttttgtttgttcatttgtcattgaaaaaaaagtcttttgttgattcaattatttttatagtgtgtttggaagcccgtttgagaaaaattaagaaaatcgcatctggaatgtgaaagttataactatttagcttcatttgtcgttgcaagttcttttattggttaaatttttatagcgtgctaggaaacccattcgagaaaaagtaagaaattcacatctggaatgtgaaagttntaactgttaagcttctgagtaaacgtggaaaaatccacattttggatttggaaccaaattttgatttgataaatgacaaccaaattgattttgatggattttgcaggagaattagccacagaactcaccatcaaaagccatggacacattgagaaggatgagtcatgggttccagtatgtgattaattgcttctcctatagttgttcttgattcaattacattttatttatttggta

SEQ ID NO: 3684 - DNA, 777 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacactgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttattaagtttggtatggtccaatgaaaaagggaagtcttttatgcattcctgaggtctgttcttgaacatggctcttttttatgtgtca

SEQ ID NO: 3685 - DNA, 779 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtggggacacagcattgccttccattcattgcttgcgcataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaaaagggatctttatgcttcctgaggctgttcttgaacatggctcttttttatgtgtc

SEQ ID NO: 3686 - DNA, 687 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacgcattgcctccattcattgttgcgcataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattaca

SEQ ID NO: 3687 - DNA, 751 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacaacggtccagcggctgttgccggtgctgtgccaggcccacggcttgaccccccagcaggtggcattcctcaattcttgtgccataccatggatggttagttcatactggcttttttgtttgttcatttgtcattgaaaaaaatcttttgtgattcaattatttttatagtgtgtttggaagcccgtttgagaaaataagaaatcgcatctggaatgtgaaagtataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttgggatttggaaccaaatttatttgataaatgacaaccaaattgatttgatggatttgcaggagaattagccacagaatctcaccatcaaaatccatggacacattgagaaggatgagtcatgggttccagtatgtgatttaattgcttctcctatagttgttcttgattcaattacattttattta

SEQ ID NO: 3688 - DNA, 794 bp, Artificial
  Glycine max FAD3B mutation created with TALEN pair GmFAD3_T02.1
  misc_feature (300): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtggggacacagtcatttgccattccattcatttgttgcgcataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaagccatggacacattgagaaggatgagtcatgggttccagtatgtgattaattgcttctcctatagttgttcttgattcaattacattttatttatttggtaggtccaagaaaaagggaatctttatgcttcctgaggctgttcttgaacatggctcttttttatgtgtcattatcttagttaa

SEQ ID NO: 3689 - DNA, 687 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacgcattcctcaattcttgtgccataccatggatggttagttcatactggcttttttgtttgttcatttgtcattgaaaaaaaagtcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaaccatggacacattgagaaggatgagtcatgggttccagtatgtgattaattgcttctcctatagttgttcttgattcaattaca

SEQ ID NO: 3690 - DNA, 746 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacagcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttgggtaggtccaagaaaaaagggaatctttatgcttcctgaggctgttc

SEQ ID NO: 3691 - DNA, 760 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacattgtgccataccatggatggttagttcatactggcttttttgtttgttcatttgtcattgaaaaaaaactctttttgttgattcaattatttttatagtgtgtttggaagcccgtttgagaaaataagaaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaatgggtaatctttatgcttcctgaggctgttcttgaacatggctcttttttatgtgca

SEQ ID NO: 3692 - DNA, 783 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtggggacacagcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaagggtatctttatgcttcctgaggctgttcttgaacatggctcttttttaatgtgtcatttatcttag

SEQ ID NO: 3693 - DNA, 789 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacctaattctttgtcgtccatcaatcctgatggcatgctagttcgatgtgtctcggcttttttgtttgttcatttgtcattgaaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggaatctttatgcttcctgaggctgttcttgaacatggctcttttttatgtgtcattatcttagttaa

SEQ ID NO: 3694 - DNA, 724 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtttgcattcctcaattcttgtgccataccatggatggttagttcatactggctttttttgtttgttcatttgtcattgaaaaaaaagtcttttgttgattcaattatttttatagtgtgtttggaagcccgttttgagaaaaattaagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaatccacattttggatttggaaccaaaattttgatttgataaatgacaaccaaattgattttgatggattttgcaggagaattagccacagaactcaccatcaaaagccatggacacattgagaaggatgagtcatgggttccagtatgtgattaattgcttctcctatagttgttcttgattcaattacattttatttatttggtagggtcccaagaaaaaaatggg

SEQ ID NO: 3695 - DNA, 666 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacggaagcccgtttgagaaataagaaatcgcatctggaatgtgaaagttataactatttagcttcatttgtcgttgcaagttcttttattggttaaaatttttatagcgtgctaggaaacccattcgagaaaaataagaaatcacatctggaatgtgaaagttataactgttagcttctgagtaaacgtggaaaaaccacattttggatttggaaccaaattttatttgataaatgacaaccaaattgattttgatggattttgcaggagaatttagccacagaactcaccatcaaaaaccatggacacattgagaaggatgagtcatgggttccagtatgtgattaattgcttctcctatagttgttcttgattcaattacattttatttatttggtaggtccaagaaaaaaagggaatctttatgcttcctgaggctgttcttgaacatggctctttttatgtgtcattatcttagttaa

SEQ ID NO: 3696 - DNA, 680 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggattgcattcctcaattcttgtgccataccatggatggttagttcatactggctttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacatgaactcaccatcaaaaagccatggacacattgagaaggatgagtcatgggttccagtatgtgattaattgcttctcctatagttgttcttgattc

SEQ ID NO: 3697 - DNA, 775 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacttgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacatttttatttattttgggtagggtcccaagaaaaaaagggtaattcttttatgcattcctgaggtctgttcttgaacatggctctttttt

SEQ ID NO: 3698 - DNA, 769 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacaattcttgtgccataccatggatggttagttcatactggcttttttgtttgttcatttgtcattgaaaaaaactctttttgttgattcaattatttttatagtgtgtttggaagcccgtttgagaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaatccacattttggatttggaaccaaattttgatttgataaatgacaaccaaattgattttgatggattttgcaggagaattagccacagaactcaccatcaaaagccatggacacattgagaaggatgagtcatgggttccagtatgtgattaattgcttctcctatagttgttcttgattcaattacattttatttatttggtaggtccaagaaaaatgggaatctttatgcttcctgaggctgttcttgaacatggctcttttttcaatgtgcatttatc

SEQ ID NO: 3699 - DNA, 787 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacactgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacatttttatttatttggtaggtccaagaaaaaggtaatctttatgcattcctgaggtctgttcttgaacatggctcttttttatgtgtcatttatcttagttaa

SEQ ID NO: 3700 - DNA, 767 bp, Artificial
  Glycine max FAD3B mutation created with TALEN pair GmFAD3_T02.1
ctcacacatgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtggggacacgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacatttttatttatttggtagggtcccaagaaaaaagggtaatctttatgcattcctgaggctgttcttgaacatggctctttttt

SEQ ID NO: 3701 - DNA, 798 bp, Artificial
  Glycine max FAD3B mutation created with TALEN pair GmFAD3_T02.1
ctcacacattgttctgttatgtcatttcttcttcatttggctttagacaacttaaatttgagatctttattatgttttttgcttatatggtaaagtgattcttcattatttcattcttcattgattgaattgaacagtggccatggaagcttttcagatagccctttgctgaatagcctggtgggacacgcattcctcaattcttgtgccataccatggatggttagttcatactggcttttttgtttgttcatttgtcattgaaaaaaaatcttttgttgattcaattatttttatagtgtgtttggaagcccgtttgagaaaaattaagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtcccaagaaaaaaatgggtaatcttttaatggctttcctgaggtctgttctttgaaacatgggctctttttttatgtgtcatatctagttaa

SEQ ID NO: 3702 - DNA, 782 bp, Artificial
  Glycine max FAD3B mutation created with TALEN pair GmFAD3_T02.1
  misc_feature (298): n is a or c or t or g
ctcacacattgttctgttatgtcatttcttcttcatttggctttagacaacttaaatttgagatctttattatgttttttgcttatatggtaaagtgattcttcattatttcattcttcattgattgaattgaacagtggccatggaagcttttcagatagccctttgctgaatagcctggtgggacacgcattgccattccattcattgcttgtcgcataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaaaagggtaatctttatgcattcctgaggtctgttcttgaacatggctcttttttatgtgtc

SEQ ID NO: 3703 - DNA, 778 bp, Artificial
  Glycine max FAD3B mutation created with TALEN pair GmFAD3_T02.1
ctctgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacagcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggaatctttatgcattcctgaggctgttcttgaacatggctcttttttatgtgtcattatcttagttaa

SEQ ID NO: 3704 - DNA, 796 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtggtttgcattcctcaattcttgtgccataccatggatggttagttcatactggctttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaaccatggacacattgagaaggatgagtcatgggttccagtatgtgattaattgcttctcctatagttgttcttgattccaattacatttttattttattttgggtagggtcccaagaaaaaaagggtaatcttttatggcttcctgaggctgttcttgaacatgggctctttttttatgtgtcatatcttagtttaa

SEQ ID NO: 3705 - DNA, 696 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacttcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaaacccattcgagaaaataagaaatcacatctggaatgtgaaagttataactgttagcttctgagtaaacgtggaaaaaaccacattttggatttggaaccaaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttattt

SEQ ID NO: 3706 - DNA, 497 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacattcctcaattcttgtgccataccatggatggttagttcatactggcttttttgtttgttcatttgtcattgaaaaaaaagtcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaaataagaaatcacatctggaatgtgaaagttataactgttagcttctgagtaaacgtggaaaaa

SEQ ID NO: 3707 - DNA, 780 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacgcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtcccaagaaaaaagggtaatctttatgcattcctgaggtctgttcttgaacatggctcttttttatgtgtcattatc

SEQ ID NO: 3708 - DNA, 785 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtggggacagcattcctcaattcttgtgccataccatggatggttagttcatactggctttttttgtttgttcatttgtcattgaaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaagggaatctttatgcttcctgaggctgttcttgaacatggctcttttttatgtgtcattatcttagttaa

SEQ ID NO: 3709 - DNA, 673 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacattcctcaattcttgtgccataccatggatggttagttcatactggctttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgatt

SEQ ID NO: 3710 - DNA, 776 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacgcattcctcaattcttgtgccataccatggatggttagttcatactggcttttttgtttgttcatttgtcattgaaaaaaaatcttttgttgattcaattatttttatagtgtgttttggaagcccgtttgagaaaaattaagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtccaagaaaaagggaattctttatgcattcctgaggtctgttcttgaacatggctcttttttatgtgtca

SEQ ID NO: 3711 - DNA, 730 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggtgcattcctcaattcttgtgccataccatggatggttagttcatactggcttttttgtttgttcatttgtcattgaaaaaaaagtcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaagccatggacacattgagaaggatgagtcatgggttccagtatgtgattaattgcttctcctatagttgttcttgattcaattacattttatttatttggtagggtcccaagaaaaaaatgggaatctttta

SEQ ID NO: 3712 - DNA, 701 bp, Artificial
  Glycine max FAD3B mutation created with TALEN pair GmFAD3_T02.1
ctcacacattgttctgttatgtcatttcttcttcatttggctttagacaacttaaatttgagatctttattatgttttttgcttatatggtaaagtgattcttcattatttcattcttcattgattgaattgaacagtggccatggaagcttttcagatagccctttgctgaatagcctggtggggacagcattcctcaattcttgtgccataccatggatggttagttcatactggctttttttgtttgttcatttgtcattgaaaaaaaagtcttttgttgattcaattatttttatagtgtgtttggaagcccgtttgagaaaaattaagaaatcgcatctggaatgtgaaaagttataactatttagcttcatttgtcgttgcaagttcttttattggttaaatttttatagcgtgctaggaaacccattcgagaaaagtaagaaattcacatctggaatgtgaaagttataactgttagcttctgagtaaacgtggaaaaatccacattttcggatttggaaccaaattttgatttcgataaatgacaaccaaattgattttgatggattttgcaggagaattagccacagaactcaccatcaaaagccatggacacattgagaaggatgagtcatgggttccagtatgtgattaattgcttctcctatagttgttcttgattcaattacatttta

SEQ ID NO: 3713 - DNA, 779 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggattgcattcctcaattcttgtgccataccatggatggttagttcatactggctttttttgtttgttcatttgtcattgaaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaaacccattcgagaaaaataagaaatcacatctggaatgtgaaagttataactgttagcttctgagtaaacgtggaaaaaaccacattttggatttggaaccaaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaaagggtaatctttatgcattcctgaggtctgttcttgaacatggctcttttttatgtgtca

SEQ ID NO: 3714 - DNA, 744 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacacgcattcctcaattcttgtgccataccatggatggttagttcatactggcttttttgtttgttcatttgtcattgaaaaaaaagtcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgacggattttgcaggagaattagccacagaactcaccatcaaaaccatggacacattgagaaggatgagtcatgggttccagtatgtgattaattgcttctcctatagttgttcttgattcaattacattttatttattttggtagggtccaagaaaaaaatggtaatcttttatgctttcctga

SEQ ID NO: 3715 - DNA, 778 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggcattcctcaattcttgtgccataccatggatggttagttcatactggcttttttgtttgttcatttgtcattgaaaaaaatcttttgttgattcaattatttttatagtgtgtttggaagccgtttgagaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggtcccaagaaaaaaagggaatctttatgcattcctgaggtctgttcttgaacatggctcttttttatgtgtcattatcttagttaa

SEQ ID NO: 3716 - DNA, 794 bp, Artificial
  Glycine max FAD3B mutation created with TALEN pair GmFAD3_T02.1
ctcacacattgttctgttatgtcatttcttcttcatttggctttagacaacttaaatttgagatctttattatgttttttgcttatatggtaaagtgattcttcattatttcattcttcattgattgaattgaacagtggccatggaagcttttcagatagccctttgctgaatagcctggtggggacattgcattcctcaattcttgtgccataccatggatggttagttcatactggctttttttgtttgttcatttgtcattgaaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttatttgataaatgacaaccaaattgattttgatggattttgcaggagaattagccacagaactcaccatcaaaaaccatggacacattgagaaggatgagtcatgggttccagtatgtgattaattgcttctcctatagttgttcttgattcaattacatttttatttatttggtagggtccaagaaaaaagggaatctttatgcattcctgaggctgttcttgaacatggctcttttttatgtgtcatttatcttagttaa

SEQ ID NO: 3717 - DNA, 712 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtggggcattcctcaattcttgtgtccataatcctatggcatggcttagttcgatgatgtctggctttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtagggt

SEQ ID NO: 3718 - DNA, 517 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatcttcttgcattcctcaattcttgtgccataccatggatggttagttcatactggcttttttgtttgtcattgtcattgaaaaaaaactcttttgttgattcaattatttttatagtgtgtttggaagcccgtttgagaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttgga

SEQ ID NO: 3719 - DNA, 637 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacagcaataatggtggcaagcaggcgctggagacggtccagcggctgttgccggtgctgtgccaggcccacggcttgaccccccagcaggtggtggcaggcgctggagacgcattcctcaattcttgtgccataccatggatggttagttcatactggctttttgtttgttcatttgtcattgaaaaaaagtcttttgttgattcaattatttttatagtgtgtttggaagcccgtttgagaaaataagaaatcgcatctggaatgtgaaagttataactatttagcttcatttgtcgttgcaagttcttttattggttaaatttttatagcgtgctaggaaacccattcgagaaaataagaatcacatctggatgtgaagttataactgttagcttctgagtaaacgtgggaaaaccacatttggatttggaaccaaatttttatttgat

SEQ ID NO: 3720 - DNA, 705 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacagcaataatggtggcaagcaggcgctggagacggtccagcggctgttgccggtgctgtgccaggcccacggcttgaccccccagcaggtggtggcaggcgctggagacgcattcctcaattcttgtgccataccatggatggttagttcatactggctttttgtttgttcatttgtcattgaaaaaaagtcttttgttgattcaattatttttatagtgtgtttggaagcccgtttgagaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtgggaaaaaacccaacattttggatttggaaccaaaatttttattttgataaatgatcaaccaaattgattttgatggattttgcaggagaattagccacagaactca

SEQ ID NO: 3721 - DNA, 590 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggattgcattcctcaattcttgtgccataccatggatggttagttcatactggctttttttgtttgttcatttgtcattgaaaaaaaatcttttgtgattcaattatttttatagtgtgttttggaagcccgttttgagaaaaattaagaaatcgcatctggaatgtgaaagttataactatttagcttcatttgtcgttgcaagttcttttattggttaaatttttatagcgtgctaggaaacccattcgagaaaataagaaatcacatctggaatgtgaaagttattaactgttagcttctgagtaaacgtggaaaaatccacattttggatttggaaccaaattttaatttgataaatgacaaccaaattgattttgatggattttgcaggagaattagccacat

SEQ ID NO: 3722 - DNA, 687 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcctcaattcttgtgccataccatggatggttagttcatactggcttttttgtttgttcatttgtcattgaaaaaaatcttttgttgattcaattatttttatagtgtgtttggaagcccgtttgagaaaataagaaatcgcatctggaatgtgaaagttataactatttagcttcatttgtcgttgcaagttcttttattggttaaatttttatagcgtgctaggaaaacccattcgagaaaataagaaatcacatctggaatgtgaaagttataactgttagcttctgagtaaacgtggaaaaaaccacattttggatttggaaccaaattttatttgataaatgacaaccaaattgattttgatggattttgcaggagaattagccaaagaactcaccatcaaaaaccatggacacattgagaaggatgagtcatgggttccagtatgtgattaattgcttctcctatagttgttcttgattcaattacattttatttatttggtaggtccaagaaaaaaaggggaatctttatgcttcctgaggctgttcttgaacatggctctttttta

SEQ ID NO: 3723 - DNA, 792 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacatctatcgcgtattaaatgtataattgcgggactctaatcataaaaacccatctcataaataacgtcatgcattacatgttaattattacatgcttaacgtaatactggcttttttgtttgttcatttgtcattgaaaaaaaatcttttgttgattcaattatttttatagtgtgttttggaaagcccgttttgagaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaatttatttgataaatgacaatccaaattgatttgatggattttgcaggagaattagccaacagaatctcaccatcaaaatccatggacacattgagaaggatgagtcatgggttccagtatgtgattaattgcttctcctatagttgttcttgattcaattacattttatttatttggtaggtccaagaaaaagggaatctttatgc

SEQ ID NO: 3724 - DNA, 755 bp, Artificial
  Glycine max FAD3B mutation created with TALEN pair GmFAD3_T02.1
  misc_feature (261): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttcctcaattcttgtgccataccatggatggttagttcatactggcttttttgtttgttcatttgtcattgaaaaaaatcttttgttgattcaattntttttatagtgtgtttggaagcccgtttgagaaaataagaaatcgcatctggaatgtgaaagttataactatttagcttcatttgtcgttgcaagttcttttattggttaaaatttttatagcgtgctaggaaaacccattcgagaaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacatttttatttatttggtaggtccaagaaaaagggaatctttatgcttcctgaggctgttctgaacatggctctttttatgtgtcattatcttagttaa

SEQ ID NO: 3725 - DNA, 675 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtttgcattcctcaattcttgtgccataccatggatggttagttcatactggctttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaaccatggacacattgagaaggatgagtcatgggttccagtatgtgattaattgcttctcctatagttgttcttgatt

SEQ ID NO: 3726 - DNA, 693 bp, Artificial
  Glycine max FAD3B mutation created with TALEN pair GmFAD3_T02.1
  misc_feature (298): n is a or c or t or g
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacactgtcatttgccattccattcattgttgcgcataccatggatggttagttcatactggcttttttgtttgttcatttgtcattgaaaaaaaatcttttgttgattcaattntttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattaca

SEQ ID NO: 3727 - DNA, 779 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacagcattcctcaattcttgtgccataccatggatggttagttcatactggcttttttgtttgttcatttgtcattgaaaaaaaatcttttgttgattcaattatttttatagtgtgtttggaagcccgtttgagaaaaataagaaatcgcatctggaatgtgaaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaaattacattttatttatttggtagggtccaagaaaaagggtaatctttatgcattcctgaggtctgttcttgaacatggctcttttttatgtgtcatta

SEQ ID NO: 3728 - DNA, 809 bp, Artificial
  Glycine max FAD3B mutation created with TALEN pair GmFAD3_T02.1
ctcacacattgttctgttatgtcatttcttcttcatttggctttagacaacttaaatttgagatctttattatgttttttgcttatatggtaaagtgattcttcattatttcattcttcattgattgaattgaacagtggccatggaagcttttcagatagccctttgctgaatagcctggtgggacaatgcattcctcaattcttgtgccataccatggatggttagttcatactggcttttttgtttgttcatttgtcattgaaaaaaaatcattttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttatttgataaatgacaaccaaattgattttgatggattttgcaggagaattagccacatgaactcaccatcaaaaaccatggacacattgagaaggatgagtcatgggttccagtatgtgattaattgcttctcctatagttgttcttgattcaattacattttatttatttggtagggttcccaaagaaaaaaaatggggtaagtcttttaatggcctttcctgaggtctgtttctttgaacatgggctctttttttatgtgtcatatcttagtttaa

SEQ ID NO: 3729 - DNA, 710 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacaaaaattaaagaaatcatagagtctagcatagtgtttggagtgaaattcttgtgccataccatggatggttagttcatactggcttttttgtttgttcatttgtcattgaaaaaaaagtcttttgttgattcaattatttttatagtgtgtttggaagcccgtttgagaaaataagaaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaaattttatttgataaaatgacaaccaaattgatttgatggattttgcaggagaattagccacagaactcaccatcaaaaccatggacacaattgagaaggatgagtcatgggttccagtatgtgattaattgcttctcctatagttgttctt

SEQ ID NO: 3730 - DNA, 773 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtggttgcattcctcaattctttgtgtccataatcctatggcatggcttagttcgatgatgtctggctttttttgtttgttcatttgtcattgaaaaaaaatcttttgttgattcaattatttttatagtgtgtttggaagcccgtttgagaaaaataagaaatcgcatctggaatgtgaaagttataactatttagcttcatttgtcgttgcaagttcttttattggttaaatttttatagcgtgctaggaaacccattcgagaaaataagaaatcacatctggaatgtgaaagttataactgttagcttctgagtaaacgtggaaaaaccacattttggatttggaaccaaattttatttgataaatgacaaccaaattgattttgatggattttgcaggagaattagccacagaactcaccatcaaaaccatggacacattgagaaggatgagtcatgggttccagtatgtgattaattgcttctcctatagttgttcttgattcaattacattttatttatttggtaggtccaagaaaaaatgggaatctttatgcttcctgaggctgttcttgaacatggctctttttt

SEQ ID NO: 3731 - DNA, 692 bp, Artificial
  Glycine max FAD3B mutation created with TALEN pair GmFAD3_T02.1
ctcacacattgttctgttatgtcatttcttcttcatttggctttagacaacttaaatttgagatctttattatgtttttgcttatatggtaaagtgattcttcattatttcattcttcattgattgaattgaacagtggccatggaagcttttcagatagccctttgctgaatagcctggtgggacacagcaataatggtggcaagcaggcgctggagacggtccagcggctgttgccggtgctgtgccaggcccacggcttgaccccccagcaggtggtggcaggcgctggagacgcattcctcaattcttgtgccataccatggatggttagttcatactggctttttgtttgttcatttgtcattgaaaaaaatcttttgttgattcaattatttttatagtgtgtttggaagcccgtttgagaaaataagaaatcgcatctggaatgtgaagttataactatttagcttcatttgtcgttgcaagttcttttattggttaaatttttatagcgtgctaggaaacccattcgagaaaataagaaatcacatctggaatgtgaaagttataactgttagcttctgagtaaacgtgggaaaaaccacattttggatttggaaccaaatttttatttgataaatgacaaccaaattgattttgatggattttgtcaggagaattagccacag

(The sequence listing continues in the following parts.)

What is claimed is:

1. A soybean plant, plant part, or plant cell comprising deletions in one or more FAD3A alleles, one or more FAD2-1A alleles, and one or more FAD2-1B alleles, wherein said deletions were induced by TAL effector endonucleases targeted specifically to FAD3A alleles, FAD2-1A alleles, and FAD2-1B alleles, wherein said TAL effector endonucleases comprise a TAL effector endonuclease targeted to said one or more FAD3A alleles that binds to the sequences as set forth in SEQ ID NOs: 8 and 9, and a TAL effector endonuclease targeted to said one or more FAD2-1A alleles and FAD2-1B alleles that binds to the sequences as set forth in SEQ ID NOs: 41 and 42, and wherein said deletions in said one or more FAD3A alleles comprise a 4 bp size deletion and the 43 bp size deletion of SEQ ID NO: 24 as set forth in SEQ ID NO: 104; wherein said deletions in said one or more FAD2-1A alleles are 63 bp in size, and said deletions in said one or more FAD2-1B alleles are 23 bp in size; and wherein the soybean plant, plant part, or plant cell produces oil that has less than 4.3% linolenic acid content, increased oleic acid content, and decreased linoleic acid content as compared to oil produced from a corresponding wild type soybean plant, plant part, or plant cell.

2. The soybean plant, plant part, or plant cell of claim 1, wherein the soybean plant, plant part, or plant cell does not contain a transgene.

3. The soybean plant, plant part, or plant cell of claim 1, wherein the soybean plant part is a seed.

* * * * *